United States Patent 12,790,634 (MOST PROBABLE NUMBER ANALYSIS OF HETEROGENOUS POPULATIONS) - sequence listing, part 41

SEQ ID NO: 28 - DNA, 6930807 bp, unidentified (residues 3,465,405-5,198,106 of 6,930,807)
  source 1..6930807: mol_type = genomic DNA; note = Enterocloster sp000155435
gaatcagtacacttctgtttacatgcatcccctggctagagcgtgtttgaaaattgctttccgtcggctgtgcgtcccactttgtgggagatttggtcccgatgatggaggcgtagcgggctacgctgactgaatcggggccaaatataccgcgaagtggggcgtgctttgtcctaagggggtacctatggtggattccttagggcagacggcgggaatgaattttcaaacacgctctaaggcacccgccgtgcccagccatgtcacaggcccgtcttaatcctccagtgcctgtctgatatcctcgatgatatctgccgcatcctcaatcccgcagctgaagcggatcatggacggatccacccctgcttccaccagctgctcatcattcagctgcctgtgggtatggctggccggatggaggacagctgtcctggaatcagccacatgtgtctcaatggaacacattttcagcttatccataaactcagccgcagccttgcggccgccctttaagccaaaggaaataacaccgcaggttccctccggcatatacttcctggccagttcataatacctgtctccgggaaggccgggataattcacccaggccacatcctccctggcctgaaggtactgcgccaccctcatggcattttcacagtgcttgggcatccgcaggtgaagggtctccagccccacattgataaggaatgcgttctgcggggactggatggaacccaggtcgcgcatcagctgggctgttgccttcatgatataggccatcctgccaaactgctttgtatatacaacgccgtggtaggaatcatccggttccgtcagacctttatacttgtcatgctgggcctcccagtcaaaattaccgctgtccacgatgcagccgccaacggtcatggcatggccgtccatgtacttggtggtgctgtggattacaatatcagccccccactcaatgggacggcagttaatgggagttgcaaaggtattatccaccaccagcggaacgccgtggctgtgggccagacgggcaaacttctcaatatccagcacggtcagggcaggattggcgattgtctcagcaaataccacctttgtattggggcggaatgcctttttcagttcctcctcgtccgcatccgggttcaccagggtgcactccactcccatcttggggaatgttaccgtgaacaggttgctggtgccgccatatatggtggaggagcttacaatatggtcccctgcctggcatatgttcaggatggcatagaaagatgccgcctgccctgaggaggtcagcatggcgcctgcccctccctccagttcacagattttggctgcaaccgcatcattggtggggttggcaagacgggtatagaaatatccgttctcctccaggtcaaacagacgccccatctgctcgctggttgtgtacttgaatgtggtactttgataaataggcagctgtcttggcccgccgttttccggctgccagcctccctggatacagattgtgtctaatgaacgtttcctgctcatgccctttatgtcctccttaagttaaatcgtgattagattatattccttattgcccagccccagcttcacggcatggtcgatgcagctcttccagttcgtatccggatgggtgtccgtaaaatggtcgtgatggcaatgctccttctcggaaagcaggcttcccggcagcaccggctgacggttcacggcatccgcacaggccacatccagggcaaccgggtcaaaggaagcaaacattcccacattcggcacgatgggggcgtcattttccgcatgacagtcacagtatggtgacacgtccacaaccaggcttacatggaagttcggtctgtccttgaggacagccaggctgtactctgctatcttacagttcaggatgtcgttggcctcatcaccaagggtatccacggcatccactggacatgcgccgatacagcgtccgcagcccacgcacttcttcacatcaatggaagccttgcggtccgtgatggtaatggcgctgtgggcacagttcttctgacaggaaccgcagcccacgcacatatccgtatgtacatatggctttccggcattgtgcatctccatctttcctgcgcgggaaccgcagcccattcccaggttctttaaggcaccgccaaaaccggttgcctcatgccccttaaaatggctcagggaaatgacaatatccgcatccatgatggcccgcccgattttggcttccttaacatattccccgtcaatgggtaccagcacgtcatcggttcccttaagcccgtccgcaatgatcatgtggcagcccgtggtaaaaggattatacccattctcatatgcagcatccagatggtccagggcattcttcctgcggcccacatacagggtgttgcagtccgtaaggaataccctgccgttttgtgccttaatcaggtccaccagcaccttggaataattaggccgaagataagccaggttgcccggctcgccaaaatgaatctttatggccgtatacttgttgttgaaatcaatatccatcataccggccttcttaaccagtctctccagcttctgcaggagattttcctgtaacgtggttctcatattggtgtaatatacatttgaaactgccatgatgtcctcctttggaatcgttattttgttattatacttcaaagattccatatattcaatcctgaaacagcaaaaaaagccccgcgataccgcaagggcttaaacatcatgaaccgctgtttttctttctgtatagcagataggaatacaccgaaggaatcaggaccattgtcagaaatatggtaaaatacaatttggacaggttgaagaagccaagtatcatcatcaggaagccccctgccatccacacatatccggccagcctgtgcgtcctgttccaattgtcctcatctgccagtgtccagggaagcttaatgcccagggaataattctgtctgcatttgggcaggtaattgcccagggccacaaaaaggaatgcaatgggtacgctgattaccgtccccacattaaaagataggccaatgcctgagaggatggtaataacctgcaccagtacggcaaggattaccacaaaccagcgtgttatctgctttaactccttagaacggctgatattctcccgtttggggtcaatcctgtagaggacattgaccagaaccgccatgaaaaacatgaaggcgggaataccgaaggcggccatgttcctgctggaatatccgttcaccacattgtctgctccccaatgggtggggacctggtccggcagcctgcggtaaaagataagtgatatgaggaatggcacaacagccagtatccagtataaaatgtcccagaatgtcagttttttatttgtcttcttcatgattgtcagcctccattaatgtctgtatccaggagagcacttcctgaaacacagtggtattcagttcataatagatatatttgcctgatttgcggtcctctatcagtccggcctgcctgagtatggtcagatgatgggaaaccgttgcaccgcttgtgtcaaaatgtccgccaatctccccggctgtcatgctcccctgctttaacagggctaggatttcacggcgtgtagggtctgaaagggctttaaacgtgtcgccaaaagacataagacaggcctccttccattatatgtggtacgctataggcggtatgtggtacgctataggcagtatgtggtacgcatggtaaccatgtcaaggttatccgcggttatcatttagatatttatctaaacgtctaaatgtattttagcaaaaaatatcccctatgtcaataagaaacatgctttttcccagatatttgcaaaaagaggcggtttcagatatgaatgatccgaaaccgcctctttcactatgaattttatattcaggcatcagccgcgccgccgtcatcagccgcacttacgcgtcccttcttcgcctcatacatggcttcatccgccttgcgcagcaggactgctgactctgtcccatcctcaggatagagggaatatccggccgaaaaacgcaccgggataaggacatggctgtccagctccacccggctttccttcatggacccaagcatccggtccacacatccaaccaggctttcccgggaactgcctccatagaggaacagggcgaactcatcgccgctgagcctggccgcaatacctttatcccagctgcatgactttaatatatctgcaatggatgccaggtaccggtctccgttctcatgtccgtaccggtcatttacctgcttcaggttgtccgcatccgccatgagcatcatggcgtgttccagtccgtgtggatcagcaaacagcccctcaagcttactgtagaatgcacgcctgctgtataatccggtgagaaggtcgacatccctctcctgtttgattttcctcttctccaggatgtcgttcgtcacatccacaatcattcccagcgtgctatgtcccctctcgaaagcttcaatcctgatgaaccgtgtttccttcccctgcagttcataaaccccgccctcctgttccagcggatgcctgcggatctgctccagcttctcttcaaacaggatatagtcggaaaatagcattccggcctctttttctcccagcatgaggatttccgccagcctgctggtagccatgacgcgcttcatatcacggttatattcataaacacccatggggatttttgtcatttccaggatatgggatatcttattggttgtatcgagcaggctttccaccatctggttaatctggctgctcagctgcttaaattccggtgtactgtccaccgccacccttgtatccagatttcccttggtaatcctggccagtttatcatggatggaggaaataccgtccacaacataacggtcaatataattggagataaaggctatcatgataagggatatcccggtaagatacagggccaccaggaatgtactgcggttcaccttctggtacagggccgcttccgacatggtaatccccagtatgaccgactgcctccgggcaaagaccccgtagctttcctcctggttcaccgtcatccgcgccaccttatccgtaatgcccagctgctccggccggatacctatgtcctgtatctgctttcccaccagtgagtcatccgttgaccccagtataagatggctctccgggtcaatggcatagatggtggaatccttttccgatgtcaccagggaaaaaacataggataactccgtttttttcatggattccagcacggtggtgggttccagccccacctggacaatccccttatggtcctccctccagacagccgcatactgcatcagcttcccctccgccgtgttaggggtaatatcctggcacatctgaaggctgtaatcctccagcatgggcaggaagaactgcatctgctcacccgaactgaaattcagtccaaaatacctgggttccgaaccggcgtaaagatttccctccggatcaaacagatggaattcatcgacctggagcagttttgttatctttgcgatttcctcctgattccccacaacctccggacggtcctggatgatataggcaatggccttggcccgtataaaacaccgttccttcaggttttccttttctttttccgcctctctcccgttctggtcaaggatctgccccacctgccagaacttgtcctgggcatcccggtacatatcattcctggcattcagcgtctggacataataatttatgaaaagggagaacagcatggcagtcaggattacaatacatagacgtttacggatcattttcttcatagccagctattccccctttgattactctgtactatagagtatcatattttaagtggggggacaagaaaattctcaggattccttcatgttcaaaagccctttccccggatggaaatcccattacccgcagatcttatccgcaggccagtacagtactcaggtcagccatatatgggaaacatacgcagcttaggtcagaaaggggcagcacctcctccggaagctgtatcccaagttcccggatgataaaatcccttcttttctgaatccgttcccagcagcccgcagacagggcagccacttccttcctgagtccttcccctgcgactatcaggccgtcctccacatgggcgctcatgaatgggtcgtggcacgtaaccgtatagtcacactggaatgccataccggatgccaccttaacctgtcctcctctgacaaaaggcgagttggtccattcatctgtgtgggtaagatggcctggattcagtgtacagccaaacttctcaagacctaactccctatccgtcatctcatatatatccccgcaggatgtgcctatcttcatcatctcatgccaggaagccacattgtcaaaataggggattaggaacccatctatatatccggacctctccaccggcaggtcatttctgtcccttagatacattccacatttatgtaccaggcttcccctaagcccataaccgactccgaccggcatcccgtactcaagctgttcccactccgtggggctgttaagtccaagggccacattcctttccccaaaattaatgttgggatgcatattggccggacttccatcaaactggcagaaggaggaggcctccagttccctcatccctggcttcagatgcctgaggcagttcagcacacctctggaaatcctggttcctgccgcttcaaaaatcacgatttcctttgctgatacacagtgcttcaggccatacctgcagtccgccatcagaagtgtggcattttccaggctatcccttggcactacctgacaaagtgtctcaatcatataatggggcacatcggtaatgaatccccctaccgtatggttggatgcatcgtacgccttaaaaccaatcaccccgatcttaccgccatcatataccacccttctctccaatatttccttcaggcgcggacttctgtcacttggctgccccataaggctgaaggtctggaagaactcaacttcaatatccacggccaccttttttacatatccgattccttcattgcccactaatatgctgggacgcccatggcgcggcaggatcagcagggtttcttcccacctggcatcatacccggtaaaataatccacattggaaaaatgctccctgtccccatatatcacgattgtgtcatatccctctgcctggggcattgcccagagcctggccatcctgccctcataatcttcttttccgagaacgggtatctcatccggatttaccggtaccgggttggtccacagctccggctctacttttttttcaattatatcatgtctcatatttatctcctgatttttcttgattttaaatcatggtatcctgcctgccggcaattttaaaagcgcatcccctgtttaacaggtaaggcctcatataacctgcgatatccgacatgggaagggcctctggtcctaatgcaatccccaattccctctccatgtagcgccgccttctctcaaaccgtttccatgtttccgggtagtctgcctgtattttctccctcagggcctcatccgccagtacaatgccgtcctctgcgccagctcctccatagcccgcttttccgggaatgatatccatctgaagcatcataccactcctaaactgtatgtctgacccagaatagataggggaggacatccattcctcgtccgcggtcagatgaccgggattcaggctccaggcaaattcatctcttggaagcacggaatcaatccgctcatacatttcccctccggtcattccgatttttatattcccataccagcatgcggctgccctgtaatacggtttagccattacatccacataatcctttaccccgtcctccatgtcctcctctccagccgccacataagccgccctggatgacaggccgccgcgaagccccatggtcagggagaatttatccccgacccttatcttcttatttcttggaaataccactgccccctgaaaccgttccccggttgcacagatcgtggtgacactgacgggttggccaaggctgcacatatatccggccacctccatctcggtcatgccgggagccagcctgtccatagcctggtacacacagtctgacgcaagggctgagccgaattcataatgcgctgcctcattggcattcaccgttgtcctggccccgtgtcccgggtggatgaacagatgggaagccgcctttaaggttccatggcctgccgctgtcttaatcccatccacaataaaacagggcacatcaaacagctggctgttgtcctccaactggctggtaaacattttccaaccagccaatcccacggccatccctgcttctatgccggcatccgcaaaaagaccggccatgtccttatcattccccatgggctggttaggcagggaaaaatacggcacatggaccagatccgccctgatggcactgtgtgcgcgcatcttcctgttttcattgcccagcatcagcactgcctgtccatcctgtttcaggaccaggaccgcctcctcaaaccttggttcaaatccagtcaggtatgcgaagttccctccatgctccctgtccccataaaccgccagtgcatccagcccctcttctttcatgcgggaacatatcttatggagccgttcgttccaggtatccgctgtcaggtcaaccggaaccagaccaacactggtttctggcggggccactgtcccatatactacttcaatatccttaggatccatccgcatctcctttatcctgtcacttccggcgtaatgtgcaggggatagacagggggtatgattttgtggtattccatattctcaattatctgatgggtggctcccggtgtgagggccaggattgccagttttgccagcttcctaagttctgcaaacagatatccctgcttcaccacaaccacctgatattcatccaggtcaagtccggccccctccgtaaaatgccccaccgaaataaaggaacctggacggtcaatcatcacgaagtccatatgttctgtggaaatggtcactgcatttcccaccgcatcgtgctcacagcccatatatccaaacagcctgccaatctttttaatggtacctgtcacttccacggcttttgtattttcatcataatcatgtcccactgaaagggtgatcctgtccccctccttgtgctccagacactttgccaccgcattctcatcccatatggaagtcaccagaaccttccttccattataatccttaagtttcaggaattccctgagcaggatggtatggtcccctacggcgccgcctgttgtattatcaccggaatcagatatatatacagggctttccggatacttgacggagaatttcacgccctcatgggggtccatcggaacctgttcaaattcaaacagttccctgtagctgtatacatagtctgccagttcccgggctatctttgcacatgcctcggtataacgttcctccgatggggtgactataatattggaggccattgtttcacagtcgcaccacaccatgccgattccaagtgttgcaacagacacctcttccattttttctatttcccacagcttatcataaatctcgcacaggggccaggttgccgctgtggccttctccggatggatggcataaggcatccttacgtactggggaaccgtcttcttgtgatgtttaatgcagtccaccatatgccgcgccacggttttctcggtcacatcctggtccgtatggggaaccgtccgatagttgcggattacattgaccagggatgccagcttgggatggttgttggcatgggcgtccagggccaggccgataatcacgtcatctcccaggagactgcggatcctcttcacaaggtcgtattcgccggaccccagtccctctacttccagactgccatgcagatgaagcatgaccccgtccacatccttgtcctgacccagaagttctatgatcctggctgaataaaagtcatatgcttccctggagcagattccgttcggcagcgtattcacatacaccagaggaacaatctcggcaccctcctcctcaaatacctgcgtggcaaacatcctgtctatcacattctgcccttcttcatatacaaaatcatccttatgtaccatttgcggattaaaggaattggcttcatgatagaacataccctctgcaatcttcataatcatctacctcttttacattatttttttaatttgaatttaaatttagctttattggtatataaatccagacatactgcaaacagaaggataattcccttaatgaccatctgcagataagaagaaatattcataaggctcattacattgtctatggctgtcagtataagtacgccacagatacatcccacgatacttcctgcgccgccgctcatgctgacgccgcctatacaggccgctgccaccgcatccagttccagaaggtttcctcctgtggaagcagcgcccccaagccgggccgtcagtacaatcccccctatgccatacatcagaccctcatataaatatgatttaaatacaatatcctctatattgatgcctgccagccgtgaggcctccttattgccgccgataaggaatatcttccttccgaaggtggtctttgtggttatgatataggacatgaatgcaataagccctgcgatgaccgctgccatgggaatccctttatatccataaaatacccagatggcaaccgctgcaaccattgcaccaagcagcaggttctccgccagatgtcctttggtgccataccattttcccatcctgcggtaattgcgaagattgataaatgcaaatgctgcaaagatgacaaccacgaccatgaccgatatgaccggggggatgaagttctcactgattgccgtaaactgtttcggcatgggtcctatggtagcacagtcggtcaggacataacccgtcccacggaatatctgctgtgctgccagggttacgataaaagcagggaggccaatccggccaataaagaaaccgttgacagcccccatcaggatacccactgcaatggtaactgcaatagccggaaatatggaccagccgcatctgaccacaaggagcgcacaggtaacgccggacagatacacacccgcgccgccgcttaagtcaatgtttgtctcaatgagcagaagcatcaggcttgaggtaagtatcataagtacagaggcctgctttaacagcatggtcaggttacgctgtgagaaaaaagcctggttcgtcagccggttgaacaggtaaaacatcagcaccactgccacacaggtccctgcccgctttaatatatgtttttttgtcttatccatcttactcctccttgtttcctaccgtggcctcccacagtatctggtccttatccgcctttttaccgtccgttatattgaccaccctcccatgtcgcatggtcagtatacggtccgatatccccataacctccgacaggtcggaagaaataaacaaaatcgactttcccttctttgcaagttcatccatgatatgataaatctgcgtcttggcctccacatcaatgccctgggttgcctcatccaggatcaggatctccgattccgcggcaatccatcttcccagcacacatttctgtgcattccctccgctcatgttgcggattaatgtttctgatgaaggcgtctttatggaaagcctgtcaatgacatcacggatcacatccctctccctgtccttattaaggattccataacaggccagatggtccagggatgacatggtgatattacgtccgacactggctatatccaccactccctgctttttcctgtcctcaggcagataaccaatcttgtaccggttggcctttccgggcgatgttatgtacactgtttttccttttatttcctgttcacatgtgacttccccattaaatcccccgataatggcaagcgctgtctcacttctgcccgcccccaccagaccatacagggaaaggatctcgccccttcgcagatcaaaggacacatggtccacaatcttcttatccggtaccttctggtccatgatggtcacattctttacagacaggaccacctcccccggcgtcctgtcatgggcagggtagacttcatccaccttgcgccccaccataagggagacaatcctcttttcatccatatccacattctcggccgtccccacgatatggccgtccctcatgactgttatgatatcggatatctccttaacctcctccagtctgtgggaaatatagatacaggcaatccccctgtttttcagttctttaattttcccaaagaggattttacattccttgtcagacagcgtggccgtaggctcatctaacagaagaaccttcacgtcgttgtacattgcccttgctatgacaagaagctgcttctgcgcaatcccgatttcctttacctttgtctgaggttctaagtccagtccaaaatcatcgatgattttctgggattccccatacattttgtgataatcaataaaaccagcatgtactggatatttattcataaagagattttccgccacactcagttcttccagcatattaaggtcctgcggaatcatgacgattcctttgttctgggcatccagtatggtcttaaactcacagtcttccccgccaagttcaattgtgccggtaaatgtatgatggggatatacgcccgccagcattttcataagagttgattttccagctccgttgcctcccacgatggaatgcacctcgcctccgaacagttccaggtcagcttccgatactgctttcacacctggaaattcttttgtcaggcaatgtatcttaagtattggttcccgtttttccatatcccttacgctccttttgtagtagccgttcagcggaatggacttcccacctggaagcccatccacttattaaaccgcgtttttacgcctgctgtcgtgttcgctaaactgcatttcaatgcctgctgttattactcactaagctgcgtttttacacccgctgttactacccgataaaccgcgtctcaacgcctgcccttactgtccgctctcaatctgctccattgtaatccaaccctccggcgcaatctgtgttgcccattcctcaatattgtcttttgtcacacctacgataggaacgtattttttcgggaccttgtaatcgccattatcaatcatctcatcgtaatccacttcctcacccttaaccagcgctatggctgcctttgcagcctcggatgcacatacatcgatctgggtccagatatccaccccgatgtagcccttattgactgcctgcatggctgccacttcacagtccatgccggtaaggtatacctgcccggccaggccggctgattccagtgccggcaggatgccaagtgtcagcacatctgccgtacatacaattgcctgaatatcgtcgttgttggcggaaagcgcattttctgcatatttaagggccttttccgcactgtatccctcacagtactgttccagcaccacttccacgtccggataggaagcaaggacctcatcatatcccttcttcatgcccagaaccacactggaggtaggttcgccgtggatgatggcaatcttgccttttccgcccatggactccatggctgccttcatctggatgcggccggcttccacgttatccctgtccagatatgcatccaggggtgcattctcaacaaaattgtcatagcagacaaccgggattccctcttcctttaccttctccacggtcgcggacatattggaggaaacagcaatcagtatcagcgcatcaatcccctgggtaatcaggttgtccacctggttttcctgctttgtctggtcataattggcccactgtaccaatgccttgcctccggccgcctcaatggtctccaccatgaacttctcatcatagtgccatctggcaccattttcattggcaaaggcaattcctatggtaaacccttcatccttgccgctggcctccttggccgcctctgtggcctgggcggctgcttctgtggcctgggtatcaccagccggtgaggcggcggttgtaccggacgttccccccgtggaacaggcggtaagggatactaccatggacatggttaataataaagctgttaatttcttcatactttttcctcctggattttatattctttattttatttattactccaatggtgtaataaatatgtttgattgaaagcatatctgtttctgtcaatccgcagattcagatatgctgttaaacatgtcaggttgtaagcaacctgtctatatactgttcctgggcaacaaatgcagcgcccatagcctcattattcttaaactccctctttttaattataatatccagattaaaatcctcattaatcagatctaaaaacttaatccttgccatctcatacagttcagggaaatccactaccatgttgcctcctaccagcagatactggggattataggtataaatcatattgcagaaagccatggccatatcctttgtcagattatcaatgatggatgctgtccactcctcccccccatggtaggcgtccatcagctccttcagctcacctatggggtgtccctgattgctgcattcccttaccacgccctgttccgatatataggcggacagacatccatgcttgccgcatgcgcagagcctgccgttgagggagaacatggtatgcccgatttctcctgccgcattattgattccgcggatcatcttcccgccatacatgacggccacgcccacgccggatccgatggacaggtatgtaacatccgcatggttcatctccgtggactggaaggtagcgcccaccaaagccatcttaatgtcattatcaacgcataccggcatgccgaatatctcctctgccttctgcctgatgtccaggttcttccatcccagctggggcgagaaacatgacaccccatttttatgatccaccagtccgcagcaggaaatccccatacatttaaccagcgacggattaatcccttctcttttacaaagctgccagaacatgtgctttccctggctcatcagcttatcaatatcatagtcctctgtctccagacgtaatatatcttccgctgccacacagcgttcgcagtcaatgagactgattttaagataatcacagtcaatggcaaatcccaggctcaaaaatgcgtccttattgatacagatattaattccatttcttccaacaccttttgagaaggcttcctcctgtttaatcaggttaagctccatcagcgaggtgatgatccttgtgatggaagtcggactcatctggagcaccttggcaatgtccgcccttgatataggattgaacttattcgtttgtatcaccctgataacagccttactattattgtacctgagtacattttggtgttgtgctgctaaatccttcatttaatttctcctgtggtgttattaatagtagtataattagttgcgttttatttgtcaactactttttgtgctatttgtatatttttttaattttctttctttgtcatcataaataatgcacagttcaatcccccctctcttaatatgatacaactatttccaaatttagtcattacataattcatttttatacaatgctgcactactccatctgtccggcaatcatgcatcagggagtcacacgcatcatataacacaaagaggacggccaaagccgtcctccttgaatctaaacacttacatcatcccaattacttcatcagtttcttaaactcatctgcaacaaactgtacctgcgtgcccacaatgacctgcacactggtcttgctgggacggatgacaccggcgataccggcagatttaatcttcttctcatccacctgggtgtaatccttgatttccagtctcagtctggtaatacagttatcaacactcgttacattctctttgccgccaagaccttccatgatgatttttgctgcctgtgtatagtcattattggcaagttttacaactgtctcatcaagttcatcatcatcctcacgtcccggggtctttaagttaaacttcgtaatcatgacgcggaataccacatagaatacgatgaacgccgcgattcccagcgggatgatcatccaggttttcgcagcagccggaagggatgctgagaacaggagatccgttgcgcctgccgagaaggagaaaccggcgcggaaaccaaccagcacggtgatgtaggtgaagatgccgtacagtacggcatataccagatacagtacaggtgcaaggaacatgaaaccgaattcaaaaggttctgtaacgccgcagataaaggcacagagggctgcggaagcaacaaggccgatagcaaccttcttcttattatcctttgcacagtggatcatggctaatgcggcgcctggtacaccgaacatcatacatgggaagaatcctgacatatacatgcccaggctccaacttacgttggcggatgtatctccggcccagaagtgggacaggtcgccaaggccaatggtgtcaaaccagaaaacgttattcaatgcatggtgtaagccgaacggaatcagcagacggtttaggaacgcatagataccggcgccgattgctcccattttggcaattgactcacctaaagcagtcagaccgccaaatacgattggccatacaaacaacaggattgcagccgcaacaacggaaaacagggccgtgacaattgcaacgcaccgcttgcctgaaaagaatgccagccagtcaggaagccttgtgttcttgaacttattatagcaggttgaaccgattacaccggcgatgataccaatcagggcgttctgaatcttagcgaaagccataccctggatgctgtccggtgcaatacctgccagcgtctgcacaacgcctggtgagagcagatgggtaatcatcagccaggataccagaccggccagaccggctgtaccatcgtggtcatctgacataccaacgccaacgccaactgcaaacaggagtgcgataatcgtgccgtcaatcaaggcaagggctgcctgtgtcaggaaataaccaatcatcgggattgcacccgtgatatcgccgccctgcatgacagccgggcagagccaataaccaataccagacaggatacctgcaaccggtaaaacggcaactggcagcattaaagatttacctagtttctgtagccacttcatcataacataaatcccctttcttaatttgagcattcttatggtattattcccataggaaaactctgatttacttgttcatgattactttatctaaacctggacccaggcttaaatcattcttaccactgtcccggcctttatccggccaggacagattccactgctttcatggcctcttcttcatccggtccgtcaatgtagaagacaacctcatcccctgccaccgtgttcatggccatgatgctcatcacgtcttttgcatccgctgtgttcccattacaggaaatcatcacatcggatcggaccttgagcatcttcatcatcagtaaggccgccggccttgcgtgaagtcccatctcatccttcaggataaagctgcgctctatcaacccatccccacctctgatcataatttaatgattgctgtctccccggcctttacatccattccgctgatgcactcaatcttcgggaactgtggtgtgttgcacacaatgacaggtgtaatcacatcatatccggctgcttttatcttatccatgtcaaagtccagaagcaggtcaccctttttgaccttatcccctgcctgcacatgggcttcaaaatactgtccctttaactgtacggtatccagtccgatatggattatcagctccgcaccattatccgtctgaatgctgagggcatgctttgtgtcgaacaccatggtaacctggccgtctgccggtgcgacaatccttccctcagaaggaatgatggccgtgcccttgccaaggatctcctggctgaatgtagggtcattgacctggctcatgggaacggctttgccgctcaccggagctgcgatgaccttcccgtccttttcttctcccccaaacagtttctttaatgaaccaaacatccttattactcctttctctgtccccctgccggggccccttaaccataatgcttttaatactactttgttctgatacgcttgatgtgcagggccaggtaagccacttcctcttccgttacctgatgcccgtactgcagtttaatcagcgcctgtactttctggctgcaggcatattcttccggatataacctgtcgatgaccttttggaactccaggttatccagttccatatgctcccctgtaaatacccgctgggccagaaaacgcagatgtgtgatgaaccgttcgtaactcagggactgttcatccagttttatattaaaatactcctctaccacctctgatacctgctggatcaggttggtgatttttattgtatcccccatgggcgcatcatattccgcgttgacgatgtggagggcaatggaggcggcctcatccacaggaagcttaatccccaggtccctgtcaatcatggcaatggcatattctccaatcaggtattccgcatggtaaaagcttcgtacctccctgattaacgggttgctgaacatcattctctggttaaaacgctccagcgcaaaatttatatgatccgtaagggtgatatacacattcgggttaatgggacggttcagcacttcttttgcatagctgatgatctcagcggatatctgtacatgctccatcggaaggttcacaagcagttccttgaacttatccatggtgttctggctgtccaggcggaataccttctctatcttctcctcatcaatggtactgccttccctggccttgaagccaacgcctcttcccattacaatgacttccctgccttcttcatcgcaggtgcttacaacattattattaattattttcgatattttcataattgctcctgataaaaacaaaaaaaccaactttgttaaagagacatacgccttttatgcgaatatcatccaatccccttaacaaacctggttttgcctgccgaacagtaacaatccttattaattatttaattatacttccaaagatttacttcactaactgaataataacaaatcttaagataaaagtcaataatattttagatattttttataattataattttcaggacttcacaaatatatagattatgcctgtaaccaccagataaaaccaggttgctgggttggaaaaccaggttgtgaaaaaggacagcatcatgtacatggcaatctgtgcgtaaatcacatggcctgccggacatgtaagcttcttcctcccccggaccaggtaataacaggcagcgcccagaagcgccccgaaaagcaccatcccaatcatcccaaagtcataataggcatcatagaacagggtaaccgtggtcagctccttctttgtcacaaacaaagggaagtccaccagtgagggcaccaggaatttaagccctgtaaatgcccacagcggaaagagcatcctaagccccaatgtatgggatggaagctgctccaccagacaattgaaattatcataattgttggcaatatacatataaggctgggtgatgaaaataggcatgttggcattcttcatctcaaatatgccgttcaggtattccacgctgtggctgcgcatcacggtaagcagcagataggccggcaccatacaggcaaacaggattcccacataaacaggcttaatgttccctgccatggaaatataggtaaagaccgccattcccactgccagtattaactggaacctggatacgcacagcacagggatggccagggccagcacattaaagcccattgccagccagaacccgccggaccttgtcactcccctgccccgcctcatgaccataaggctgtagaccacggaaaggctgggcaccagcacacaggcaaccgtaaaataatggacaccgctcacatggaaataagaatacgcatggggcacaccataggaaaaaagcggtatgaacccaagcttccaggcctcaaaggcaaatgccagccaggaaaccgccaccagccctgccatggcctgcaaaatacgcctgacctggtatggtgattctgccgatgcatagaaccggtacacggattccatatcatcctcgctccagccgtcaaaaagccttgaaagcacctcaaacacaccccagaaggccaatacggccagtcccaggcacagccaggtcatattgtcccaatccccctgcaggcggctcagcttaaaacaggatatcccctgaccgcccacgaaaaagaggcagaacagccccctcagatggatgatgttcccgctgtccgcataatccctgtaatacagccacagggcggctataattaaaaccagcccagacagcatataaaaatgctgccgggccaatatgaaactgataatataactaacaagataaactggcattatactgttccattctccacaaattctttcatatactgttctgtttccgctgctgttgcaaaacccatggccttgtcagcaaccgcctgaagttccctggtgctgtaggacatgaccatcttcctggcctttagcatggcagacgcgctcatgctgaattcattcaggccgaatgcaagaagtaacgggatcatcatcgggtcgctggcagcttcgccgcacatgcccaccatgatgcctgcttcccgtgcacaggcaatgatgtgcctgatgctccttaacacggcaggattaaaggtggaatacaggtaggacaccttcttattgcccctgtccaccgacatggtatactgtgtcaggtcattggtaccgatgctgaagaaatcagcctcctttgcaaagatatccgcaatcagggatgcggcggccgtctccaccatgatacccacctggatgtccttgttataggcaattcccttgctgtctaactccttcttaagttcctccaccagtgcctttgcctcacggtattcctcaatacaggtaacaaggggaaccatgatgcggatgtttccaaaggcgctggcgcgcagcagggcgcgcagctgcggcttatagacatcctccctgcggtccaggcaaaaacggattgcacggtagccaaggaacgggttctcatccttctccaggcccatgtacgggatttccttgtcgccgccgatgtccagggtacggatgatgaccggcttgccgttcatggccgccgcgaccttcttatatgcctcaaactgctcttcctccgtaggcatgacagtcctgtccataaacaggaactccgtgcggaacaggccgattccctccccgtcatactcaagcaccttatccacatcctcaggcttgccgatattggccacaatctcaacccttaccccgtcctttgtgaccgaagccttgccgataaactgctccagctccttcttctcttcctggaaccggaccttcttagcctcataatcagccttaacagctgcttccgggttcacatgtacttcgccggtgctgccgtccaggacaacgtcatccccgtccttaacgccttcaataaaaccgttcacagccaccacggccggaatctcaagggcccttgcaaggattgcgctgtggcttgtcctgccgcccagctccgtcacgatacccgttacattggcaggattgattcccgctgtcatggacggtgtaaggtcctttgcaacaaggatgcttcccgccggaagggaggaaatatccacggactggatgcccatcagcacacgctgcatccgtgtcttgatatcacgcatgtccgtggccctctgctgcatcagttcatctcccatggaggcgaacatatccgcatacatattgcatacattctcaatggcaaattcactgttgaccccatcatttttaatggaattctcaatctcccctgtcagcatggggtcagacagcagcatcatatgcccctgcatgatttccgcttctttttcccctaccctggtagccaggtcctctgccagacgctccgtgtccttgatggtctgctccagcgctcccttaaaacgctgtacttccgcctccccatcacccactgcctgtctggtgattaccagctctgcttcttccacaattactgcttttccaatcccaatccctgcagaagcgctagttcccttgtacatactcttgtacctccttattgctttcatttatactcacaacctttggttgccgtcactctccagttaacccgccatcctggcggccgttactcccctaaaccatcctccacaatctttaccatggcggctaatgctgcttcctcatccggtccctcgcagacaaatgtaatttcatccccagacttcacacaggcgccaagaacactgaggacacttttggcattggccgtggtggtccgtatcttgaaggatatcttggatttatagagcaaggcctccttgcagaggattcctgccggcctcagatgaaggccggacgggttcttaataacggttgttgcacttaccatgttacctctctcctttgcgctgcacctctttgtacagtgctgctatattctgatgcatccgtggccagctgcccggataaacggcagccaggacctagagcgtgtttgaaaattgctttccgtcagctgtgcgtcacactttgtgggagatttggtcccgatgagggaggcgtagcgggctacgttgaccgaattgggaccaaatatgccgcgaagtggggcgtgcagatggcgggaatgaattttcaaacacgctctagagcctgcggatggagggaatgaattcccggacactatgccccggttgtttccttcacaggatccccggattcatcggccacggaatggctttcgccttcttctgttgtctcatctgccgcagacggccctttctcagtgactgttaccagaacgctgttgccgcttacaagctcataggcatcgcccagcagaagcgttaccgtccccatgttatcccctggttccatgctgcttacatccagctcagcctggattgctgcagctgtcagctggtccaggtcttccttcagtccctttactactatattgagtgatttcctgtcatattcataatcatactggccggatgcgccaacctgcttaatctggctcacaggcatctcatacgtcctgctctccagggcctccaccttgatgaccaccttaatctcattggcagccgggtccgccagctcaaccccctccggcaggtacttgttcaggtcaatggtgacttccttatcccctgttgcaccgtccatgttcagctcagactttgggaccgtgaccgaattcgccctggccaggtcggacttgagtcctttgacctccacgtaattcctgctgctctcaatgcccgtaaaccggtaaccgtctgccactgtcccttctgtctcaaaggtcaggttcaggttcttctccttcagtatggggagggtataatcaatctcagagcggctgaaggtcaccctgtcgccaatctgatccgtaaggtcattgttattggcgtcaaagcacctcacaggcaatgtgcctgacaggtcgctgttggctccctcaacattaatcacaatccccacggaactgatccgtccaaccacggacacgggtccgcttacatatatatacgtgggtgaaacagtggccacgccgggattatatccatcctcgggcacgccttccgtctttgtctcaagattaaagggcttgcgctgtaaatcctctgtctcaatccggatgacgctgggctttgataccacggattccagcttgttgctgttattcttcacttccagtttaaccggcaccgcgcctgtgggttcatacacatccgccaaatcaatataggccctgaaatcagacgcctttatattggcggaatccgatgtggttaccttatagtacacgctgaccgtgtccctgtcgcctatgacttcatatgtctttccgctggattcaaggatactctcattgagtatttccaggggcacctcctggctgcgcgtaacttttggattcgcaatgttcatcaccgccagccatacaaagaatgccaggaagacggaaagtactttaagcccaaggttattagacagctttttttccattcttcagccttcccttccatattttaaaacggtttaaagaaacagattcctccttaacggtggaaaggatcttctttaagccttctgcgtctgcaattttagtcagcatcccttcctctgccacggaaacccttcctgtttcctcagaaaccacgattgtcacactgtccgtcacctcgctgacgcctactgctgccctgtggcgggtacccaggtccttgctgatggtcatgttgtcggacagcggcagataacaggtcgccgcggtaatgcggtttccacgtatgacaaccgcgccgtcatgaagcggggtgttgtgttcgaatatgttaatcagcagctggctggtcaccaggccgttaatctctatccccgtcctctcgatttccttcagggaggaccctctctcgattaccatcagggcccctgtctttactttggccatctcaaaggtggccctgacaagctcgttgatggtcctgtcactgaacgcctggctgtcctttccgtcatcaaaggaaaggatgttggatattatgttgcggcttcccagctgttccagggctttgcgcagttcaggctggaatattaccagcagggctgtcactgcaatggtcgtggtattttccaatatccataatataacggtcaggtggaacacggcagcaaataccacaaacagcaggatgaccagcaggccctttaacaggttccatgccctggtgttcttaatccatacaaggatttcatacaccaggaaggagatgataaccatctccagaatattcccaagtgatatccttggcagcagagtcagccatgatgacatctgtcctaacatttctgccatgtcgtcacctccttgcatttaatctttttcattaatacacgtttctctcccttgtgctgcgttttctggaacttattttctgtacttttacatccggggtgctcacgttcatcttgggcactgccttgacgtaataataataatcgtcatcttcaaactggacatattccgtcctggtataatccactgtgatgataaagaaattatataccaccgcaatgagggttgacaatagtatgcccagaatcagctggcccactgccacggatacgccaaaaacaaaatcccccacaaagataaccagcagttctgccacggaaccggctacgatggcaatgatccatgaataatccatggacagcctgcgtatcagatacacgatgatgatgcccacagcacaggttgcaatcatgaccatcatggtctggttgaatatgacggacttaaggatctggctgtacttctgcacaatgtcaacagagccttcattggtgaggacacctgcattctgctttacatacatcacaagataatacaggaaaaccccgcaacccaccggaatcacggatgcaaggctgcctcccagtcccaccaaaagagggattgcgtagggaatcttaaataggaatgccaggggtgtaagtacaatcaggtagctgtccccgggcttgaaaccatagtaaaggattgcaacggtcaatataagcaccagcgtaatcagagccatctccagcgacaccgcataaacatgggccacaagaaggcaggctgccaggaatacgatggcgccgtagggtaaaagggaacttaccaggcataccaggatgattaccagcgggttcttaagcttgttcatatagccgatattggcgttcaggctcaggaacgtacacagtgcaaacaggaaacggatgaccggctgtacgccataactgtacttattataaaattgctttaattgctctttccatagcagaagacttgtcatctggcccttcctcctctgttatccctcattctgtcagtcctgtccttatcgtagcgcttcagcagatgcttaagcttggaagcgtacatggtctgggagcgggacgcgtaatcatagcgcttggcatacacaatccaggtaatgaacaggtaaaccaccaggcctgccacatagatgatcccccactgctttgcagagtgaaggatttcgtcaatactcatatcattcagcagctcgtccagtttatagagaacccacatcagaagcagcagacaataacagaaggtatacccaaaaaatgagcggaacatctgtccgcctacataatcctttttaaaatagcggttgatagggaatatcttcttgccttcattcttttcaaatatggccaattccgtcatatatttgaccttttcctcgttcagcataggcactccttaggaatctcataacatatcaatttagtataccacaagtttttatgttttgcgacaccttaaattaatttttatgtttttgtaaggaactggaagaattgtttccccaaaaagaacaggtgccgggaattcattccggcgcccgtcctattttccgctttcaccattcaggtatctggaaagcagcgattccaatgcatccaggtcaatgggttttgaaaaatgtgcattcatgccggcccttatggccgccctcacatcctcctcaaaggcattggcagtcattgcaatgatcggcatacagcttacatccctccgttccaggccccggattgccctggcagcctgatatccatccatgaccggcatctggatatccatgaatatcaaatcataatatccttcctccgacctcatcaccttatccacggcctctccgccatccacggcctcctcaaccatgattcccatctcccggatcagggtcccggcaatctcccggttgatttcattgtcttctaccagcaggatccgtttccctttataatccagcctcttttccgtccttttatcctctcccgcgcttccgtccaatcccctgagcaggtaacacattttagagcggtagaaaggtttggagataaaggcagtaacccctgcctccctggcctcacactctatctccgaccagtcataagcggtcaggatgatgaccggcaccgcctcccccacattttccctgatacggcgcgctgtttcaaccccgtccatgccaggcatcttccaatcaatgattatgagttcatatgggtcttttgtgtcctttgcatccgccacatatcttacacctgtttctccgtccgtgacaaagcgggccctgagtcccatatcccgaagcagttccactgcattgaggcatgtctgcctgtcgtcatccacaatcaggctgtttatcccaagccaggcctccggcacctgctccttaggcgcatcctgcagcttaagcggaatggatatggtgaagacggaacccttgccgggactgctttccacatgtatatccccattcatcaggtctatgatgttttttgttatggccattccaagaccggtaccggcaaccctcatgccggcatggtcccgggcgcgctcaaagggctggaagatatgttccaggaatgacggttccattcccacccctgtgtccgtgcagcggaacacatagtttgcataacccaggaccgggctttcctcctgccatgcctcaatcctgacaaatcctcctggcggggtatattttaccgcattgctcaggatattgatacatacctggcgcatccggagggggtccccaacaacattttcatgcttcatgggtgaaagacagacatccatggcaagccggcctgcgtttgcctgcgaacgtataagctcggccgcatcagcaaccagttcagggaaattaaaaggttcgtccctcattgagagttttccgttctctatctttgacatatccaggacatcgttaatcaggcttaagagatgttttcctgaaagattaatctttttcaggcattccagaaccctgtcccggtcgtcaatgtgtgcggctgctattgccgtcatccctatgatggcattcataggggtacgtatatcatggctcatgttggaaaggaagcggctctttgcattgcttgccgccttggcgctgtccagggcgctctcaagagccaggcgctgctgttcctcttcatggcgctgttcgtcaatacggcgtgaaataaggatggccagcatatcatctgaataaggattatccacatagatgatctgggtggatatccagtgatactccccgtccgccagcagatgctttgattccaggaatacctcattcttattatgtaccaggctttcacgcagggattccagtgaaaaacggcttgcgtattccttccggttatccgggtgcacgccggatgaaaaatcctcataaagccggctgtatgtttcctggcttcccaggtccgtcatgagaccctgtctgacatagatgaaattcagggtatccctggtcaggttcaggcgtatgattaccggataggcattggagatggcccctaccaatgtgatgcgttcctggagcttgtcgcgttccgctgcttcctcttccagtttctcggctgttatgtcatgaaaggttgcaatcagcacaggggttccattttcatccatcgtcttctccagaatacctgctccccagaaaacttccccgctgtttttcagcatgcgcttttcaaatccggccttgcctccttcccttgatgcatggtcaaggagccggtccatatcctcatggtcatccgggagtatgacttccctgatgctccttccggatatggcctcattggaggtgccttccggatatccaagcagttccatcccttccctgttaagctggatgaaccggttgggttcttccacagttatcagggcaatgccttccggcacagcgttatacagatgtccgatgtaggcggcctggtccatgagccgcttattggtccttctcacatagcggatataaaaggcggccaggacagatatccccaatatgatgctggccatcagggacagggcccgcatgaggatttcattggtctgctcattcacggtatgctgcgggatgattgataccagataccagtcagactgcagctttagcggtatgaagcagaatacggtcttttccccctggtatgtgaacacagcccagccatttcccgcgttttccagggcctggctgaactcttccagctgttctggcgcattctgcggcacatccagcatatcaaaaaggttcctcacggttttattgctgcccggatggggggaacggatcagtatatccccctttgtgttcacaacataagaaaagcctgcattatcataaaaggaaagactgaagctgtccacaatggtgtccacttcatactccttaaccagataagcctttgtaccgtcagccaggacaacctgattgtagaggttgaacacattcacccctgtcacgctgcttatatgcgggttgatgatgccgctttccccctgctgtccgaatatctgtttcccggcctcttcatcccatcccccatgtccgggcaggcaggtgccgtcgggaaggtaaaggcttaccccatggcgtgagcgggcggagtgctccagtatttccccaatctcctgcttctgcagcaaagaatatccgcccagctccactgccgcgtcctccatatcctcatacgcttcctgaagctgtatgcgcagtgtggtacagccctgcttcgtgctttccatgattgtatggatggactgttcccaaagctgcgtgctcacatcctgcacgaaaaggaaggtaaggaaactaagggccgcgccaatcaggaccgctgccaggatgatttttgatttaatgtttacaccattgtggtccgtcatggtgtccctccttctgtaatgccctgtttatccatccagtccatgacagcttcaagcggctcccctgaaagaagcttccgggaaacctccgccgtcaggttccatattggaagttcgagaaatccgtccgtaccgatcacggtcctgccttcctggtagcaggatatcaaaggttcaatttccttgacagatgaaggcgccccgtttttcagcgggcttaaggaagactgctggtccgcgaatttctgaatattctccggcctggtaaagtattccacaaaccgcgccgccgcctcgggatattcactgtcagcattgatgctcagacgcgtatccgcattaatgaccacaagattcccctcatccaggaccgggtaagggaccacctggaacttaaaatccggttccatgccttttacccgaccggccgcccatgcgccggtcagcatgaagggggactcacccctgacaaattcctccaggtcatctgaggttttcattgttgtaagggatttccctgcatccacataacctctggttatcagttcctctgccagggaaaagccaggccccagatacctgctgatgggttcctgtcctctgttcaggcgttcaaacacctccatctgacgtttttcctggtatacgtcataaaatcccctgccgattgccagtgtttttaaggaaatgtcattattggcaatgaccggcgtcatgccctgtgaaagaaaatatccacatgtatcctcccactccccaaggttttccggtatcttctgcttatgttcctttaacaggtccatattgcagtaaaggccaaacacggacacggttgtaggcagccagtatatcttcccgtcatcccccatctggctgagcatgatatccgtataattagaaagcgtactgacaccggaaaggtccgccagctgtcccttatcccgcagctccagcaccgtgtcatggttcaccatgaagatatcatcccctttaccagccgccatgcgcctgcagagggcgtcataatattccgttcccttcaggctctcataggatacccgtacgtccgggttttccttcatgaaaccagtaatgatttcctcaatcacgatcacgttttccgtctcatatttatttccaaaaaaagtaatcatcacaggctcttcctgggccttgccgtaattcaccacccggtttccggcgccgcagcccgatatcagggccgcagataaggctaccgttatgaaaagtcctgattttattccctttttcattgatattcccctttaatctacttctcttaagacaaacatatatattataccacgttacggtcaaagcaaaaaggacatttctaaaatccctcttagaaatgtcctcttactgctaatcagaaataaattccctgttcaggaatgaatcatcaaacaacctcttagtacagctttgcaccagccgggatatggtcgtccaccaccagaagatggagcccttctgccccgtcctcctcatgtaccgcagatatcagcataccgcaggaatcaatgcccatcatcttgcgcggaggcaggtttacaatggcaatggccgtcttcccaatcagctcttccggctcataatactcatggatcccgcttaagatcgtgcggtccgtgcctgaaccgtcatctaaggtaaactgtagaagtttcttacttttcggtactgcggcacagtctttgatcttcacagcacggtaatcagattttgcaaatgtttcaaaatcaaccatttcttcaaacaatggctcaatcttcacgttagaaaaatcaatttccacttctgctttttcttcagcatccacggatttccctactggcttttcagccttcttaggcgcgtcagaaccgcccagtgtcttcatggtcgggaacagcagcacatccctgattgccgctgaatccgtcagcagcatgcacatacggtcgattccaaacccaatgccgcctgtgggaggcatacccacttccagggcattgatgaagtcctcatccgtgtggtttgcttcctcatccccctgggccagcagttcctcctgggccttgaaacgctccctctggtcaatggggtcattgagttcagaataggcattggccatctcccagccgttcatgaagaactcgaaacgttccacatactccggatcctccggtttcttcttggtcagcggtgagatttcaatgggatggtccatgacaaaggtcggctggaccagatgctcttccacaaactcctcaaagaaaaggttcaggatatcgcccttcttatggcgctcctcaaactccacatgcttttccctggcagctgccctggcttcttccagggtgtggatctgtgagaagtccacgccggaatacttcttcaccgcatccaccatggtaatacgttcaaatggcctgcctaaatccatctggatcccgttataggtaatggtggtggtccccagcacctcctgtgccacaaaacggtacaggttctctgtcaggtccatcatgccatggtaatccgtatatgcctggtacagttccatcagggtgaactccgggttatgcctggtgtccagtccctcgttgcggaatacgcgtccaatctcataaaccctttcaaggccgcctacaatcagcctctttaagtaaagctccagtgaaatacgaagttttaaatcctcatccagtgcattgaagtgggtttcaaaaggtcttgctgcagctccgcccgcattggcaaccagcatgggggtctccacctccatgaagccttccccgcccagatacttacggatggcggcaagaatcctggaacgcttgatgaaggtatccttcacctccgcgttcatgatcaaatccacgtaacgctggcggtaacgcatatccgtgtctgtcagtccatggaacttctcaggaagcacctgaaggctcttggagagaagggtcacctctgtggcatggatggaaatctcgcctgtcttggtggtgaacacagttcccctgatgccaaccacatcgccgatgtccattttcttaaaatccttatacggctcttcccctacgctgtcgcgggcaacatagacctggatattgccttttaaatcctggatattgcagaaagaagccttacccatgacgcgcttgaacatcatacggcctgctatggctgcttccttcccttcccactgcccgtaattgtctttcacatccatgctgtgggcagtcacatcatattttgtaatctggaaagggtcctttccagctgcctgaagttctgccagcttatcccgcctggccttcagcacatgattcaaatcctgttctgcctggttaaccttctgctgatctcccacgtttcgcactcctcctgcgttcatctattctatcaatcggtttccttatgaaaccctctggatttccagcaccttgtactggatatccccggcctgtgtctccacttcaacacagtcacccacaaccttgccgatcagggcgcggcctaccggcgactcattgcttatcttattctgcaggctgttggcctcggtggaacctacgatatagaattccatctcttcatcatattcaacatccagaagcttaaccttacatccaatgttaatcttgtcaaggtcaatctcatcctccacaacaacctctgcgttcttaagcagcttctccagctcctcgatacgcagctcgatgtccctctgctcatccttggcagcgtcatactccgcgttctcggacaggtccccctgctccctggcttccttgattttctgtgctacttcttttcttttgacaaccttcagattctgcagttcatcctcatactgtttgagtccggcatatgtcaatatgtgtttcttatccgccattttacctgcttccttccttttgattctttgatttatgtttgttttcacttaagtatctgtcttactacctacacattcagtgtattatataagaaaatatggctattgtcaagaatggtttccatcttttcaccgtggatctgacggcgggattgacggtgcggtccgattcagaagtcctgccagtcctttcagggtttccacctggttgatttcgtttctgagggcagctgaatggggcatccccttggtgtaccaggccacatgcccccgcatctcacgcatggcggtctgttcgcccttgtactccgccagcatatgcccatggcggaggatcattgcctgtatctcttctatagaaggtcctggaaggatttcccctgtgtccaggtaatggctgatccgcctgaagatccacggatttcccttggcgcccctggccaccatgattccatcgcagccggtctcctccatcatacgcccggcatcctggggcgtgaaaatgtccccgttcccaatcacaggaatcttcactgcctccttcacctgccggatgatatcccagtcagcctttcctgaatagtactgttcccttgtcctgccatggacagccactgccgccacgccgctggcctcagccatttttgcaaactccaccgcattgacgcaggtgtcattgaatcccttgcggaacttgaccgtaaccggcttcttcaccgccttcaccatggctgaaaggattttttcagccagttcaggatttttcataagggcggagccttctccgttattcacgatcttaggcactggacaccccatgttcacatcaatgaaatcatatggaccgtcctcaatcctggcagcaatctgagccatgatatccgggtccgagccaaagagctggatggctgccgggcgctcctgcgggtgtatctgcatcagctcctttgtgttcctgttattgtacaggatggcctttgcactgaccatctccgtcaccacacatccggccccctgttcgcggcagagcagacgaaatggcaggtccgtcactcctgccatgggtgccagtatcacattattgtcaagaatggtgtttcctatccgcagttccatctattcttcaccgtccaggtccaggtcttcccccaggaaaaatgtcctatagtacagttccagggattcaagcatctccctcttttcttcctggtactgcttaatcttaaggacactgccaatctcatcaaacaggtaatcctcctcaggagccgtgaccttgaattccagggctccgctgtcatcaaactccagggtcaggattccccccacatcctcagtataaagaacgcacatgatgtgcagctcatccttaatggactggggcagtgaactgaactcctggttaaaataatacttctgttcataggaattggctccgcagagcacctttgtatccatcatctcatctctccacaaaagtccgctgccccggaggagataacctaccgcaggcgcggactttccattcattctatattcggatgcggccagggccttacattattgatacactgccgcagcgccccttaccttatgagcagctttgcaacctcatactgctcttccggaatatcctttttcatgttcagggcttcctggatatcataatccacgaattcgccgtgcttataggccaccagacggttgctcttgccttcagccagaagttctgccgccttggcgcccatgatggaagcgtaaaccctgtccttacaggtcggcgtgccgcctctctgcatgtgtcccaggatggttgcccttgtctcgattccggtggctgcctcaatacgctttgccatggagccggaatgtccgattccctcggcgttaatgatgatattgtgcttcttgccccgtctgcggttatcgatgatccggttgatcagcgcctgctcatccccgtcataccgctccgggagaaggatatcctctgccccgttggcaatgccgcaccacagcgcaagatagcccgcgttccttcccattacctccacgatgctgcagcgctcatgggaggtggaggtgtcacggattttgtcaatggcttccatggcggtgttgacagctgtgtcaaaaccaatggtataatccgtacatgcaatatccaggtcaatggttcccggaagtccgattgtattgattccaagggcggaaagctttcccgcgccccggaaggaaccgtcgccgccaatgaccaccattccgtcgattccatgcttgcggcagatttcagcgccctgctgctggccttccggtgtggtaaactccttgcatctggctgtgtaaagtatggtaccgcccttgttgatggtgtccgatacgctggtggactccatatccacaatctcttcttccagaagtcctgcgtagccacgcatgattcccttcaccttaagtcccttgttaattgctgcacgaaccactgcgcggattgccgcgttcattcccggcgcatcgccgccgcttgtaagtactccaatggtcttcactgcctttgccatagcaatttacctccttgtattaagcgcctgcgtccgccgcctgcgcaatgtcactcttattcattctctcattttatgcccaacgctattctaatgcatttttcccagcttttcaagacctttttctaccactttgacatttttttcaccaagttcatgctgcagcccttgtaaaagctggtccgtgacatgtacattccaggagggggggagcatctttttggcccgctccttctggagatagatgaccacccggtccttcccttcgctggacttcagcagggaaagcagcttctgttccctttcctggtaggcctccttatccgcaaactggacccacagctccttgggtgtgtcctcaaaaggcaccacctgttcacataccagcttccccactgggtcatcacctatggaaaccctgccgcggataaagagcttggcgtcctcggtaaacagttcacggttgccttcatagtccttggggaacacaatcacttcaaccgaacccatcaggtcttccagggtaatgaacgccatcagctggttggtcctggtggtcttcaccgtctttccggcaaccatgcccccgatgacgaccctgctcccgtcctggacacctgctttttccgtttcctcatctaccatgaaatcagcagatgttgcggttatgttcctgcgccaggcctcctcatagtcatccaggggatggccgctgatgtatacgcccaggatttctttttcaaaagcaagcagttcttctttggagtattcccccacatctggaaacgtaatctgaaactcgttcctggcctcctcgccggcaatgtcaaacaggctcagctggccttcaaacatggatttgcgttccctggccttctcctccagcatggtgggcgccaccgccatcttctgccgcctggttccgggcagcgtgtccagggcgccggatttgataaagttttccagcgtcctcttgttgacctccttcatggacatgcggcccacaaagtcctccatggaacggaacggcccgcccttcccgcgctctgccagtatcacatccacaaccggcttgcccacgctcttgatggcggaaagcccgtagcggatggcctcccctgacacggaaaaaccgctctccccctcattgatatccgggggcagcacaggaatccccatcatccggcggcaggtaaggatatattcagaaaacttgcccacattatccatgaccgacgtcataagggcagccatgaactcgcggggatagtaatatttaaggtaggcggtctgataggataccacggcgtacgcagctgcatgggacttgttgaacgcatactttgcaaagtcaatcatctcatcgtagatgtggttggccgtcttctcatcaatcccgttcttcacgcagcccttaacgccctcttcctcattgccgtacacgaaattatggcgttccttttccatgacagaggtcttcttcttactcatggccctgcgcaccaggtcgctgcggcccatggtgtatccggccaggtcccgcacgatctgcatgacctgctcctggtatacgatacagccataggtggggctcagtatgtgttccagctgggggcactcgtaggtaatggattccttgtcattcttgcctttcaggtaccttggtatgaaatccatgggacccgggcggtacagggagatacctgcgatgatatcctccaggttctctgccttcagctccttcatgaagcttttcatccccgcgctttccagctggaacacgccttccgtccttccggtcccaatggactccagcacctgcttatcgtcaaaatcaatatggtctatgtcaatgcttatcccataatccttctcagcaagccgcaccgcgttctggatgacggtaagggtacgaaggcccaggaaatccattttcaggagtcccagctcctctatggtggtcatggtgaactgggtggtgatggtaccgtcgcttgccctggaaagtggtacgaattcatcaatggaccggctgccgatcaccacgcccgcggcatgcatggacgtatgccttggcaggccttccagacgcttcgacatgtcaatcaggttacgcacctgctggtcttcattatacgccttttttaaatccggattcatcaccaatgccttatcaagggtcattcccaggtcattgggtatcatcttggcaatggtgtcgcacatggaatagggcaggcccagcacccttcccacatccctgaccacgcccttagctgccagggtaccgaaggttacgatctggaccacctggtccttgccgtacttgcgtaccacatagtctatgacctcctggcgccgttcataacagaaatcaatatcaatatcaggcatggacacccgctccgggtttaagaaacgctcaaacaggaggttatagcggaccgggtcaatattggtgattcccagggtataggacaccacgcttccggccgcggagccgcgccccggtcccaccatgatgccctgggaacgggcataattgatgaagtcccagacaatcaggaaatagtccacatatcccatggtacggatggtatccagttcataatccaggcggctgcttaaggtgccgtcatcctccgggtatcttgtcttaaacccctcccggcagagatggttcagatagctccaggaatcaaagccttccggcacttcgtatctgggaagcttggtaacgccgaattcaatctccacattgcagcgtccggctatcttgtgggtgttctccagggcctggggcgcataggggaacagggccttcatctcctcctcggacttgcagtaatactgcccgccctcatagcgcatgcggtcctcatcctccaccttcttgccggtctggatgcacagcaggatatcatgggccttctcatcctccgcgaatgtatagtggatatcattggttgccaccagttcaagcccggtctccctgctcatgcgcatcaggccctggttgaccagcttctggtcaggcagcccgtggtcctgcagctccaggaaaaagttgtcctttccaaatatgtccacataacgtccggctgcccgcacagcctcctcgtacatgcccctggtaagatacctctgtacctcgccggccaggcaggcgctcagggcaatcaccccctggtggtactttgcaagcacctcataatccaccctgggtttataataaaagccgtccacaaatcccttggacacaatcttcatcagattctcatacccctggttgttctctgccagaagcaccagatggtagtacctgtcctcgccgctgacagtctccctgtcaaaccgggagttgggcgccacatagacctcgcagccaaggatgggcttaatgcctgcttcctttgcagctttataaaaatcaatcacaccatacatcacaccgtggtccgtaacagccatgctgtccatcccaagctctttggccctggctgtcagctctttaatcttgcaggagccgtctaacagactgtattctgtatggacatgtaagtgggtaaatgccattggttctcttctccttccatatgagttatagtttagcatagatccggtcaaaagaaaagaaccaggttaaagagctcccggttcttaaatctatgatcatactctgtataaggcggttgttattcctggttcttcagatacttctcaatctcagaaactgcctgttcctcatcatcaccttcagccaccactgtaatggcttcaccggcagtgaggcacagggtcatcattcccatgatgctcttggcattcacgcgcttcgcctcagcttccagataaatcttgctttcgtactggcttgccacctgtacaagcatagctgccggcctggcttccagccctgatgacaattcaactgtgatcaatttctttaccataattatcctcctcattcctttgaatggtacgcagccatgtccgctgcccaagcagccctgtcacggcttccattccggtgcccatactgaattgtacttaatgaaacaatactaactgtccggcaactgctgccgcaggtcatccgccatctggcccagtttcctcagacggtggtttacacctgatttgcccactggcggttctaaggcctctccaagctcctttaaggttgcttcaggccgttccagccgtatgcgggccatgtcctgaagactttccggaagcccgtcaagtcctatggtctcctggataaaacggatatcctccatctgttttaccgccgcagacacggtcttgttgatattggctgtttcacagttcacctgacggttcacattgccgcgcatccctctgagtatccggatgttctccagttccataagggccacgggcgcctccatcacgttaaggatgtccacaatctggtccccttctttgatatagaccacatagtactttttcctcaatactatcttgggttccatatcaaacgcggctatgatgcctttaagctgctcagcctttgccatggaagggcagacaatctcaaaatggtagaatttctccgggtcactgattgaacccgcagcgagaaacgcccctctgataaaagcccttctgcaacaggcattctgaaccaccacattgcgtaccagcgacagatcctcccggatctcaccctgggcgtcaatgagcttggccgcctgaagtaccttaagtgcatcatcatgttccctgactgctacaatatatgtccggttccgcgaaacattcccgcctctgcgaattgaaacatcagtacttatattaaatgtttttttcaataatgtaaagtactttcttgcaactgccacattttctgtatgcatttcaatggaaaaatggtcggacgccgatattttcacccggccgcaaaggcttaatatggcagacatctccgctatccggcaatgtcttgcagcgcttgcctgcctggaaagttcatcttttactctggaagaaaatgacatttttatgctacttccttttattatctttgtcaatatccctgtgttcaatcttaatgccgtaggtcttgtggccggacaggtgcccgtaaagcgcattggccatggcaaccgaacggtgctttcccccggtgcaccccaccgcaacaaccagctggttcttgccctcacggatgtaattggggagaaggaaatcaatcaggtcatacagtttatccaggaatgcctgtccggtcccgccctgcatcacaaaatcccggatgacctggtcttccccggtcagcgggcgcaggtcctccacataatatggattgggcaggaaacgcacatcaaagaccaggtccgcgtcctcgggaatcccatatttgaagccgaaggaaaggatggtgatgaacatgttattgaaatcctggtccttaaggaaaatcttctccagctcctgtctcagttccctggtaagcagctggctcgtatcaatgatgaaatcggcatccttcttaaggaatgccagcttcaggcgctccttctcaatccccttgtccagacggccggccccggcaagaggatggctgcgccgtgtttccttataccgcttgatgagggtcccgtcattggcatccaggaacaggacctggtaatccaggcccgtgtccttccatcccttaaggatggcctccagctggttcagttcctcgccgcttctaatatcaatcccaagggctgcctgcttaatctcaccgccgaccgccgccagctgtgagaatttatccaccagtgaaatggggaggttatccacacagtaaaagcccaaatcctccagcatcttgagcgctatcgtcttgcctgccccggacattccggttacaatcacaagcttcatccatccacctctgtcccgtctgataatatgccagtactgcggcctgtcagaaccggccccagcgtttcacttccatctccagttccacaccggaggtttccatgacctttttcctgacatggccgcaaagcgccatcacgtcggatgccgttgcgctgccgctgttgattacaaacccacagtgcttttcagacacctgggctccccccacctgatatccccgaaggcccgcgtcctcaatcagcttgccagcaaaatacccctgggggcgtttgaaggtgctgcctgcgctgggatattccaggggctgcttctcccggcgccggtctgacagttccttcatcctggcttcgattgcagccctgtcgccgggttccaggccaaatacggcttccagtacgatataccccttggatgggatacagctggtgcggtaccccaggtccagccggtccgcatccagcacaaggacctcgccttccggggtcatgaccctggcttccctgaggatatccttcatctcaaaaccataggcgcctgcgttcatgaccagtgcgccgcctgcgctgcccgggatccctgcggcaaattccatgcctgtcagggaatgcttaagggccagatgggccgcccggcttaacagctggccgcctcccacgcgaaggaatctgccgcatgcctccatatggcagattccctccatggcaatcaccgctccctcgcagccgctgtcgctgaccagaaggttgctgccattcccaagaatcctccagggcacatggtaggtccttaacacacgcagcacggccgccagttcctcctcgccggaaggacttataaagacctctgccggtcctccgatccgaaaggacgtatgtctgctcatgggttccatgaacctgcatcctggcagttctgattcaaggatatcttttaatgtgtgttccaaattcaacttgcaatcctcactcaatattcattttcttaatcatcgctggctttcccaaggttggcctgcactctgttgtacagctcctgggcagcattatagcccatcttcttctggcggtaattgactgcggcggattccacgatgatggccaggttacggccgggacggatgggtattgtatggcataccacctggttgcccaggaattccgtgtagctgtcttccagtccaagcctgtcgtattccttatccctgctccagtcctccagctttatgaccatgtcgatgttctgggtatccttcacgctctccacgccgtacagggtcttgacatcaatgatgccgattccccgcagctcaataaagtgcttggtgatatccggcgcactgcccaccagggtgtcatcactgaccttgcggatttccaccacatcatcggtgataagacggtgtcccctcttaatcagttcaagggcagcctcacttttgccaatcccgctctctcccatgatcagcacgccttcaccaaatacatcgatgagcactccatgaatgcttatgcagggggccagcttgacattcagccagcggatcacttccgccataagggcagacgtggtcttatcggacacaaggcagggcacgccgtaataattacagaactccagcaggtcctcatccggttcctggctgcggctgaatacaaggcagggaatctggctggatgtaagtttatcatacatcaggcgcttgcgctcctggtccatggtattaatatatgcctgctcaacgtatccgatgatctgaacccgttccctgtcaaaatggtcgaaaaatccggtgagctgcagggcaggacggttcacgtccgggtgtgtcagcacgatcttgtccgtgtcaatatccggagtggtgttgcgaagcttcattttctcaattaattccgatatggttactccatgcatggtaatacccccttaagctgcttatgcttctattttaactcttatcatactatcatactttaaacttcttgtcatgtgttttctcccaagtcagcttccagaatctggaacccaatcactggctttcctgtgcgctgccgcccatgtcatcctgcgtcttaacctgcgggccatcctggacgccctccggcctgtcttcatggaaaaacccataaaccgcaagggccgcccgcttattcatctggggcgcctgctccagttcctccaccgaagcggcccgcactgactcgatatccttaaagtggcgcatcaatgccttcctcctggccggtccgattcccggtatatcgtccaggatggatttcacctgtcctttccccctgaggcttctgtggtactcgatggcaaaacggtgcgcctcgtcctgtatccttgtaatcaggcggaacccctcgctgtgcctgtcaatgggcacttctatattattgtaatacagccccctggtcctgtggctgtcatccttgaccatgccgcacacgggaatagaaagtcccagcttatcaaggacctccagggcgatgttcacctgtccccttccgccgtccatcatgatcaggtcagggaaccgtgtaaagcttccaagatttaaatccccgcccttttcctccagctcccttacctcgcgcatgccatgggaaaagcgtcttgtgagcacttcctccatggacgcatagtcattgggaccctggactgtttttatcttgaatttcctgtaatcactgcgcttgggcttgccgtcctcgtacaccaccatggagccaacggactcaataccgctggtattggatatatcaaatgcctccatccgccggataccgccgataccgatcagctccccaatctggttcatggccccgatggtacgcagctcctccttcttaatccgttccttgtcctgggacagcacaagggcggcgttcctggcagccagttccaccagacgttccttctccccctttttcggcacaacgatgcgcaccttctggccccgtttcgcgctcagccactggctgatgacctcctcgtccgccagtggatgctgaagccacagttccctggggataaagggcgtccctgcataaaactgcttcacgaagctgtccaggatttcaccttcgttctccgccattgcagccgacacatggaaatggtccctgccgatgagcttgccttcacggataaagaacacctgtaccaccgcgtccttctcatcccttgccatggccacgatgtccctgtcctccatactgctgctggtaatcttctgcttctgtgcaacctgcttcacactgtttaacagttccctgtactcaatggcccgttcaaaatccaggttttccgaagcattctccatcttttcctgcagtgtcttcagaagcgggtcatatctgccattgaggaaatccagggcctggctgaaattggcctggtactcctgggccgtgatgtatccctggcagggggcgtcacactgcttgatatgatagttaaggcagggcctgtccctgccgatatcctttggaaggcttctgctgcaggtccggatacggtacagcttatggatcaggtccagcgtgtccttgaccgcgcccgcacttgtataaggcccgaagtatttgctcctcccgtcctttttcatatcccgggcaaacagcagccttgggaactcctcgcccatggtcgctttaatgtaaggatagcttttatcatcctttaacatggtattatagcggggcctgtgctccttgatcaggttgcactccagcacaagggcttccagctccgaatccgtaagtatatattcaaaccatgcgatatgggaaaccatctgttcaatcttggccgtcttgttgcggctgctctgaaaatattggcgcaccctgttcttcaaactgatggccttgccgatatagatgatctcatccctgttgttatgcataagataaactcccgggctggccgggagtttcttcagttcttcctctaaatcaaacaatgctgtcattcctccatgtcaatctgttcaaaccgccagcgctgttccacatccggatacttcccatggtccacctcgcccataaacatactgaggggccgcacatacgtcttatagtccccgtaaagcgcctggtagaccaccatcttctcgcctgtctcagaatgtatggccactgtcactatctgatacagcttatttttaaagtgcctgtaaaattcaccaggctttggtattctgtccatatctgtccctgcctcctgtgcggcagtgcccctgctcaaggcacagcccctattcacggcccagtcccagtccccgccggggcctctgtctccgatggcggcgcagcctctgtttccggcggcaatgcagccctggactcagcaatctcctgttcctctgcagcagcctcctccggcgtcagaagaccgccataatggtaggatacccctgcatcccacaatatccactcatcatatcccgaatcatagacagcctggatctgctggcgcacctgctcatccccataatcaatataatccttgagataagaagctgtaaaatcctgcagccacggacgcacgaccgcctgtcccgcatcttccttcctggaagccttcagcaatgtcgcggaatccttcaaggcatgcctgatagtatcatacggctgcgcgtccggatttgcaataccaaaattacccgggccgtaatgggaaggataaatcatgggacagatatagtcaagatgctcagccatatccccatattcctggcccacggccgccgcatcctcttcgcttctcatgatggtcccaaacacatccgcggacaccaaaagcccttcctctgccagttcatcatatgcatagctgacgaattccgtaatggcctgggtcttgtcacgccccccggtatcagcctcatcaaacaccacgtccttcatggtcttatccacggcaaaccggatataatcgaactggatttccttaaagcccatctccccggccttcttagacacctctaccagataatcccatacttccttcttatatgggtttacccaggccagtcccttattatcccggtaaatgctgccatccgccacatgcaggctccactccggcttctgctccgccagatacggatccctgaatgccaccaccctggcaatgggataaatcccatgctcctccagcttgcggatcagccccggcagatccccgataaatgcctggcaggccccaatctcattcacagtaggtgaatccatatcaaacgtaatacggccctggtcatccttcacgtcgataaccaccgcattcagttccgtccggtcaatctcctcaatgatcttatccatcatatcaccggttcccgccacataagcagacacatagatgcccttcaccttcacccggtccctggggggatacttggaaatagtgatggcctctgcaggctccgccgcctcctgagcctgccctgtctccggttccgtccggctttcctctgccatcgtcatctcctcagacggctcataccgggtacatccggttaaaatcaatgcaatgatacctgctgctatccaccttttcatacgtaacctctgtcttcctcattcttatgctatctatcctcaaaaggcaaatgcctgtaagtccggtgaatccggtaatttcttccattcgttcccactataatagcataatcctgtggatttgtacataaaatatgacatttttgttacgatttcattaatttctcccactttctgtaaaatactaaatagttccccaggttctggcagcataaaagacggggtggattctgccgtcaaaaccagaaacctccccgtcttttatattgtcaggccttagaagctatccctgcaaagcccagggtcccggccccgccgtccgtcctggcccgcttcgcagacgcggccccgcgcagtctgccctcacgcttcctgcagatgtttcctaagcgccttcctgacagcgcccttccccgcaatcagttcagcaaagatatcctcagtatatccgcccagccctgcttcatacagatccacgccaaatatggcggcgttgctcaaaatcggctggagaacggcatggacatcgcagggctcccctactttgacgcccttcagtttttctgccagctccccgtacatcgggtcagggctgactgtaaatgaattgccttcatcatccacgcccagaagataacggcaccatccagcctgcaccatgggaatgaacttaagggacctgacatccagttccggtcttgcaagatactccttaatggtttccccgaagcggatggacagcttctgggacgtatcgcatgcaatcctctgcggcgtatccggcatgaatggattggggacacggattttaagcacctcgtcaatgaatttcctgggtgacaggatgcccgggtcggtcactaccggcagaccttccttatagccaatcagctccaccagtttaaccaggtccccgtccttcatctcttcgctgatcttcgtgtatcccaacaggcatccatacactgccagcgttgtgtgaagggggttcaggcaggtgcagaccttcatgcgctccactttctccaccgtatccctggtcgtgaacatgacgcctgcctgttccagggccgggcgtccattggggaacgcgtcctcaatcaccaggtactccgcctcttccgcgttgacaaagggcgccacgtaagtgttcctgcttgtgacaatgctttctgtgtcggtaaaacctgcagcttccagcatttccttaacactgtcatccgggcgtggggtgattttatctatcatgctccatgggaaggacacacgggcaggatcctcaatgtactccaggaatccccgggccgcctttccgttttccgtccaggcttttgcataggcatccactgccgcaaacagcttatcgccgttgtgtgagcagttatccatgcttaccagggccagaggcgctgcaccatgggtatatctccagtggcacagggataccagttttccgatatagctgtccgccatatccgggccagcctcaaaatccccagctacatcctgacggtaagagccgtcgggggatgtgatgccgtatcccttttccgtgatggtgaagctggccatctgaagggtgctgcttgcgaaaatatccttcaggcggttccagtcagcctcatcctgacggtccacggccagcgactccgcaaggctgccgattactgttttctcaatggtcccgttggctttcagggttacaagcaggcttaaatcatcctggggtctgtatgccttcttaatgatttcataatcatagccctctgccacgatgatcccggttttctccacgccctcatctaaaagcttctgctgaagcgccgccggaaatgcgcggaagatattgcccgcaccgaaatgtacccaccgggggcattccttcgtggcttccttcatggcatccctgtcaaatccaggcagcctgattcctgccttttcccactgctccctgtccttcagttcactgtctaataaatgcatagcctttccctcctgaatgaatgatactgaccaatattgttatttgcgcgttcctgaaactcatggttttatcttatcaccctgaaaaggaataagccatgtccctttttgccgactatattgcaaaacttacggtaccattcccgccgggaaatatagggtgggacccaggagcatatcatggaaggaggtaacaaaaaaagacctggccgcctggtcttttcctgttatattgccttgccttacttttactgaatcatcgaagttgatacattggtattttctttctggttaaacataccgtccgaactggctgctgtggcattaaccataatcagcagcgctgcaagcaggacccatgcaaaactgcccagtaccttcctgattttcatcttactccgcctcctggattcgattcataagcatatacttcacctttttgctgcttagtctaagtccgttatcttattatacaaactttttcaaaaaaagcaagtcctattcctcttacgctgtcttactttttccttaaaacactggaaaatacatatatttttttaatataaaggggaataggaatcaatccttcgttctttaaatagatgtttgacctgcaagatcaggccatggcctgaaaacgctgtttttatcccctcaaggaaatatccctgtgaaaattttcaccattttgaacggtaaattctgcgttatttcaatacgggagcctggttttaagttaaactttaaatacttatatcacaagaaaagaggaaacaccgtgattacatacgaacctttttggaacaccctaaaacagtctgaggaatctacctatactctgatttataatcataacctgtcaagttccaccattgaccgcctgcgcaagaataaacctctgagcaccaccaccatcaatgacctctgccggatactgaactgtgatattgatgacatcatcacctacagacgttccgaaacagatcaggcgctgtaatcccgcgcccacttcagtattccatggggaatcacgtccaaaacagcccattgacaggaaaaaggcgggctgccttgtttgggatgctacccgtcagacaactccgccttttaatctgtatactatcctatctgcttctccctgctatctcaacagccagttttgccaccgaatccactgcagacaccgcgtcatcttcccacagcgcaaacagcgtcccattgtacccccatgtggcaagcacaccgggtatatcggaattttctattgtaacctccaccgtgatgataatttcagtcccatcctccgacttggctgtccatgtccctttcctgctgtcatcaaacatatagtagaatacggacgggtccccgtcctcttccctggatgcgcgtagtatggcgtctgaatccgttatcccgtcatggaacatgacctgctccacagttccttcctccgtactgtagaccgggtccatgcaccagttttcattttgcggaagtcctattattatcccgtcctctttccctgcctcagattcctctaaatcctcatgggattctgccgttccatccgtcccgtccgttccatcctccccgtcatcagccgccgcgccgtgatacccatccgtactttctgcttctgtccgggcagatgtcacagccgtactgtcctttgccgcaccgctgcctggtccgcaggccgtaaccagcatggcagctgacagtgccaccggcagcaccgccggcgccagggctgaccttatccaagatttcatccgttctcctccttccgtatgatgcaccgcagccatatgttttttgtaaatgcagtccatacagtaccagtttaatgcctgtactttccggtgtcaaataaaagcggatgactgattgaattctttcatgggtgtctgtcattcatatcttccgatatattctactgatatataaaacccgacaggtcatatagtaccgccgtccctgtacattccccctccagccggatcttgccctcaaggccgtataccctggtggtaaagacttccctgccttgatttacaaatatctccagcgaagacgtatcagagaatatctgcagttcccgcagttcctcaagacggacacaacgttttgtcctgccggagcctgcatttcccatatccagggtcagaaggccgtcctcatacgtcagggtaaccccctggcggagtgtcaggcgcatgtgtccgcaggattcaaaacggaagcagccctcgaacacaatcccatcctccccggccgcattcaactgtcccagggcaaatgtcctctcattgcagcgcatctgctgcagttcccggaccggctcctggacaaggcgtccttctttccaatgcaggacacgcggaatggtcaatgcatgctgccatccggcctgcgtggtcgggtttgtataatccgcatccgggattcccatccagccaatgagtatacgtctgccgctttcatccaaaaagctttggggcgcatagaaatcgaatccccggtcaaccatggcagcggcatccagagggatattccggcatatatcatcatccaggccatggtccaggcccatgaccgtgcactgatgtacattccagtaatccacgccgctgggttcaaccccctggggacagcagatgaggcacagctggccgtccagctcgaacaggtccgggcactcccacatatatccaaatgtttccttggtggtaatcctgccatgatatttccaggaccttaaatccggggactcatataacagcaccagacccttaccatgtgcatccctggctcccagcgccatataatacatccgtcccctcttaaatatcttcgggtcccgtatatggcagctcatatccccgggataatcctcattgcccagcaataatttcttttcagtgaaccggaagccgtccctgctgtcaaagctgattgtattgctttccctgccatccataatatagtcataatcatcccggtcaaaccgtttcacattgcctgtatagaaatagtggatggtaccgtcctccacaaaagcagagcctgaatacacgccatgggcgtccaaatccgtatccgggaacaggacaggttcctcattggtataacggacaaaatccgttgtggtataatgcccccacagtttaatcccgcccgtaggctcaaagggcgtatattgataatagatatggtacagtccgtccatctggcacaggccgttggggtcattaagccagcccgtttccggcatcagatggaatctcagccgtcttgggtcggacgccacccgttccctgtattcctgattctcctgataccatttctcataatctttcctgaataccttacgatacttttccacctgcgtcctcctgatgtcttattttatctgcgcaccgccattgccctggtccctgcatccgccccggccaaaggatatacctctgtcttcagtcccccgccctccggcaggatcatcatggtctggggattcaggcccttttcttttatcagctttaaatcagccagaatcagcttatccccgcgctttactttatctccctgggccacatatgcctcaaatccggctccgtccagctgcacggtattgataccgatatggatcagcacctcaactcccgtatcggatgtaatccccaccgcgtgttttgtggggaacagaaggcttatggtcccatcgcagggcgcatgaaccataccgtcctcaggattcagtgcgattccatcgcccaatgccctggaagcaaatacctcatccatggactggtccacgggaaggatttcgcccttcatgggagaatacaggatagtggtggtttctgcatctcccgtatgttccgcacctcccgcgctttccacatcttccgctgtttctatgccctctgctctgtttacttctgccttcaccgctgtttctgccttcactgctttttttccctctggtttctccagcccgaacctcttccagaacacaatggtcagtataaaggatacgcccatggaaagcaggatgccgattgcaaagttcaggtaatggtcaggtttcatggaaatgaatcccggaagccccgctgcccccaatgcctgggccagggtcctggttcccgccaggtatgcgcttcccaccgcggaacctgtcatggctgcgtagaatggatattttaatttaagtgtgacgccaaacatagctggttcggtaatcccaagaagcgcggatataccggaagcggaacagatggatttaatcttgtcgttctttgtcatcagaagcacggccaggacagctgctccctgggccacattattcatgcttgcagtggaaaagatgaagctgcctcctgtatgggcgctgtcagccaggagctgtgtctcaattgcaatgaagctgtgatgcataccggtcatggtaataggcgcatacgcaaaaccgaacagcgcgccccccaccggcccaagggtattataaagccatgtaatgcctgccgccagaaggtttcccgcctcccttaaaacagggcctacaaatatgaaggtgaggaaggatgtcacaaggatggacagcaggggcgtggtcaggttatccagccaggacggcgtgatcctgcgaagcctcttctcaatattggcaaggatccatgacacggccagtaccggaagcacggttccctgataaccgatggctgcaatctggaatccgaaaatattccacattggcgggtctgcaataccgatctgatatgcattcagcagatccggatggaccattatcatgcccatggccgcgcccaggaacggattgccgccgaatttcttcgtggcgctgaatccaatgagcacgggcaggaatgtaaacggcgcattggcaaaggtattcacggccgttgccaggccctgccactggggaaacagttcaatgacggcctgcccattaaacaggggcgaggtaagcaggttattaagtcccatcagcagaccgcctgcaacaatggccgggatgattggcacgaaaatgtcgctgagcatcttaatgaaccgctggatcgggttgcctttttcctccctggcctccttatcctccggtccctcctccatattacccagctgcttctgtacttcggcgcagaccaggttcacggtacctgagccaaagatgatctggaactgggactgtgttaaaaatacccccttcaccccttccaggtcactgattgcctcctcatcgcgcagttcgttgtccttcagctgaaagcgcagccttgtcgcacaatgggccactgatttaatattgctttttccaccaacatacttaattaccagacttgcggtttttgcataatccataaccttacctctttcttctcctgtttttttggcatcggttccataactaaatattaatacttttacccatttatgtcaatactttatggcaccggttcctctttttgaacgtaaaaaaatactgcggttttttatgcatttttcacaaaaacacaagaaaaccgcagccactattcttattttcctattttcttacactctttccctcaatcatccggtaacccacaatctgttttttcggcaccggttcctcccttatcatcttaagcagggtctctgcccccagataccccagaccataggcatcgaatttaagggttgtcagttccggtttcaggagggtgctttcatcataaccgccaaagcccgccactgacacgtcctccggaatcctaagcccatgcccttccaatacccggtacgccccaaaggccagacggtccgtggcacatatgagggcatccagcggtccctggtccagcagctccctggccatgccgatcccgctttcatagctgtaatccccggacacctccctgatgcagtccacgccgcattccctcagcccgtcaatcactcctcttttcctggcaatacccaccgcctcgtcggattcatccacccccatgtacccgaccctgtcaggatgactcctgccaatgcaggcccccatggcctttcccgccccgtaatcatcatatacgacgcatatcccttcgtcataatcctgggcaagcaccaccacgggaaccggactgttcctgatgagttccctgtgttcatccgtgatattgatggcgctcagcaggattccgtccaccttcaaggtaatcagcctctgtatattcttaagttccaaatcaatgctgtggtccgaatccttgataatggcctcatacccctgctcccgcagatagcgcccgatactggtgaccacccggctggtaatcttggaattcagggtagggaggaccactccgaccacgttgctctcccttgccttcagccttgcaaatgcattgggctggtagttatactccctggtaatctcctgaatcctctgctttgtggattccttaacgcttcccccgttaaaatacctggacaccgtgctcttggtaacgcccgccatggcggcaatatcatccatcgtaatgtttctgggcatatacacatccttcttcctgatatcatatagggaaccgggcagatatggccgcatttgcccggttcctgcttttgttctagtatagcagaaatccttctgtatgtcccgccttttttgccggtcatgacgtgctgccggaccgccctatcttatctcactgccaaagggcatcagcgccagctttgccagtttgaactgctgcagcccgaaggggatgcccacgaccgtcatgcagagcagtgcgccgatgatggctgattcaattgcaaggggcaggcccgagacaacaagccagatgatattcagcagcagggaacccgcgccgccgccatacacaacctctttcccaaagggaaaaaagctcaggcttgcaaatttgaagcactgcagacccaccggaatcccgatgatcgtgatacaccacagacagcctgtcaggagccagctaagcccgctgatgcagcctccgaatataaaccataaaacattcccaagacaacccattacacagtccctccttcttccggcggcaattccgcccttaattcatacagacggctgcggatacgcatcacacgctgctttgcctcctccacctgtgcctctgcatccttaatcctggtctgtaccatccagtcggctatgatgccgtcaaaaaagtagtccgcaaatgtgaggaaatcccccacatccagcttgaactcgcccggaagctccacatccagaagttcccgtttcagcctcctcaggtgtgacttggctgtttccatggcatggcttgcatcatccatcctggaatgcttcatgaaggtacccaacataccgccgccaagcagatcccatacgccccatccggctgctttggacagatatcccgctgcctcctccaggctctgcagcgccctgtccgccgccgtgacagcctctgcaatttctttcctcatgtcctttttctccataacaatctcctttctgtcatccgacactcatatggttaaagcatgtgcgcggcagatgaatggggaccggctgcgatatttaaaaagacttctatcgtggtcggcaatctgccacaataaaagtcttgcacatttcattttatacgggtgcttgttaaaaagcaccaagaagacgatttaaaatccaccgatggtggttcgctactcccttttattggaatgtattatatcaccgccctgattccatgtcaaataagaattgctaaagattatattaagatttctttcgtttcagctgatataaagcacgggcacatctcccagtatccgtttaatcccggaccgcaggaaagcctcggcttcctccctggaatccgccctgtaacagtaccttcccctcccccgtcccgtcatctgctccttgtcataaaggtccggcgcagccggaaatgcctcactgttgattgcccggtggacataggaataggtcatcaggatgacctccaggaacatctgtcccttcatcttccggctaagtccggcttccagttcctccaaaaggccggtatacatctccctccacccttccatcaggatgaccggggcaataagaagcccgcatggataaccggcatcacacatctgattgactgcctggatcctctgtttcaggctggaggtccccagctcaatcctgctgatgatggcctggggattgacgctcatgcggaaaatcacctttcccctgtgttccagattcagtaacggccccaccatatggaacttggttggaaatgtaagcttcccctccccctcttccgcaaatcttggtatggtataaagcaggttatccgtaattgtattctccagcaccaggtcgctgttgctcccaatctcgaatgtcagcggattcccgccctccctgcccttctttatgatgcggtccagcatctgctccctgttcacaaaaagcctcagatatgcgcacttattataattacagaccagatagcaatacaggcacatggccgtacaccctgaggacgtatagggaaccaggtaatcggaaaccttatggttctccacatatttatgcgttttccgaacacctatgatcaggttccgtttcatatgcccaaattccgagttgggcttttcctgcatttccttgatggaattgtggctctcaatgggaatccatgtaatgtccctaaaatcttccctgagcttctctcccaggggataggacatgattcccggttcataatataccgcgtcgaatttcatgctcctgcctttcaccgtatggatggttttagattagtctgtacggttttcagtggaatcatgcacggcggaacatacacattaagggctcattatagcttacagctataatatgaaaaaaacacttgatttttggaaaaatttatgatatattcttctagtcggggcattagcgcagctgggagcgcgccacactggcagtgtggaggtcacgggttcgaatcccgtatgctccatttgataagtttaaatccggactcttgttaaagggtccggattttgttttgtctgaacaactcagctttttacattttcccctgcgccctctcacacagttccatgatatatccgcgccttgcaaccacatccagccatgcttctggtataccgcgggcgccataatatatcccggccagacctccggccacggcccccaccgtatccgtatcatcccctaaattcactgcctttaatacacactgttcatatgtatctgtattcagcagacaccataaagccgcctccagcgtatggaccacatacccgctgctggatatatctttttccggcagcttcatgaatccatccaaccgccttaaccggtcataactgctgatttcagactcctctatactgtctaatagcgcaagtgtcatgctggtatcatccgaccatgtaccagccggctggctatgggtcccatatcccctcatggagacggccggatcatctgcaatctccgccctggatttaaactctgccggcactcctaacgcatcacctgccgtcaggccaatcacgccgtcataaatctgttttcaaagtcccgcctcctgcaccgaattcaaaacttccttaagccttcccgcctcctccgcggacaaggtaatcccttttcccatcttctcatggtccggcgcccaatcgcggatatcgtacttgggagccgcgccattccagctgataaggttcacttccttgcgccatcctttggcgttctcagacaatacgcctaattcttcttttatctcaaatttaatatcgctcattccctatctcctcccaaaatcttaaatcattaacaacaaaaacttcaagaaactttcacattatcttcaatacctttttgctccaatcagttatattattatcagaggggacttccggtccccgccgccgcagcataaaccacacctgaatgaaaggagcattccatggataaaaaaagagtttccatacccgtcctattatttgctgtaatctgcacagccctatgtaccgtaatcgcatcacgatggtatttcatgaaccagcatggggatgggtacaaaacccagctggcaggaacggttgtctccaatgatggcagccaattgaccataaaaggccaggtaaccaatcccaaaggacggaatggtacgtatgcagttaaatatcattccggtttgaccgtgtatgatgcagccagaaatgaaatagcgttttctgatttacagccaggcagccccatatccgtttactatcaatggaacattcctaaatatgtatcgccacgcacggaatttaatgagttattagccctggaagaaagccaggaaataccgggcgtattggccattgcccttcttgaggatggcgaatcgggtaaatcacttgactttttcgagccgggtcttaccacgccctgattggaagcttaccgcttttcactttgtcaggtcatagctttcccctatcatccgcttgacgtccttatccggcacggtcccatccattaccacggtattccaatgctttttattcagatgatagccgggacgcacgccttcgtatgtcctgcgccagaattcaatccattccggggagcatttcagattaatgcatacttcctggttcctggcgtatatccaggcaaagacctttttattgttccggtggcgtatgactgcccactcatggtcgcggaagggatagtcctcgtagacatccttgtaggtcaggcagtatttaattaaatcctgttttgtcttcatgtaattccgtccttcccttttctttacatggttttatcattataccagatttttacccataaagccatccaactccataagaaaggcatgccagcccctgattttaataccgggcggcatgcctttgctttactgtcagtaccagcggaccatgggcagttcattgttcacgcccttgctcaccaggatctggtgcaggtcaatcaccccgttgtggaaggtggctgcgcaggaacacagatacagatcccacatgcggacaaattccccgtcaaacatttccctgacctcatcctcatgttccttaaagttcttctcccagcagagtaatgtcctgttgtaatggttcctcaggttttccacgtccagcacatggaaatcatggtccgccatcagggatatgatttcccttaagctggggatgacgcctccgggaaaaatatatttttttatccatgggtcccctgcatgctccttctggctgctgatataatgcaaaaggaagactccgcgcggtttcagcaccttatccatgcaatccatgaacctgccgtaattctccctgcccacatgctccagcatgcccacgctgacaatacggtcaaacttcataccggattccggcaggtccctgtaatccatcagttttacactgacaagctcctttagcccttcctcttctatcctctttgtaaacccctcgtactgctcacggctcagggtgattccggtcccccttaccccatattcctttgcggccctgattagcaggaagccccagccgcagcccacatccagaaggtccatccctttctccagggccagcttctttaatatataatccgtcttattgacctgggcctcgtaaagggtgtctctatccgtcttaaagtaaccgcaggaataattcatggtttcatccagccacaggcggtagaaatcatttccaatatcataatgggaggaaacctccatctgctggttcttcctggaattggaaggatgaagcagctttttcagccgggtctggttaacggaaaaccggtccatctgtccaaggaagtggtccagggcctcgtacagattcccctccacgtccagccttcccttcatgtacgcttccccaagggccagggaagtactgtctgtcagttcctttacaggaatgctttccttgatattcactgcaaagattggattgccatgcccaatccggtcctcatgtccctcccaccttaccagaaagggataatccgtaaagcggttcaaaaaatgcaccattgctttttcttctaacatactggtatcacacatcctctccgccagcccattttcctgccttttagcagcctggtccggcatatgtcttcttccagtattatccccttttggaaacagattatacagggatgcccctggcgggcatctctgcacaccaggggcatctttaaaacaattcactattcaggattagtcattaccgtataaagtaaccagcttctctaagtaagcgtaacgctccttagcctcagcctcgttacgtgcgaacagctcagctgccctctcaggattcttcatggccagggacatgtaacgtacctcaccctttaagaagtcctgataggtctccagcttaggagccttggaatccagggagaacttcttctcagcagcaggattgtaacggaagttattccagtaaccgcactctacagccagcttctcctctgtctgggccttgtccatgcccttcttgataccatggttgatacatggagcgtaagcaatgatcagggatggtcccggataagcctctgcctcggcaattgccttaacagtctgggccatatcagcacccatacaaatctgtgccacgtatacgtaaccatagctcattgcgatacttgcaaggtctttcttcttaacgtccttaccaccggcagcgaactgtgcaacagcacctgtcttggtagccttggaagactgaccgcctgtgttggagtaaacctcggtatcatataccatgatgttgatatccttgccggatgccagaacatggtccacgccgccgaagccgatatcgtaagcccatccgtcaccgccgaatacccactgggacttcttagccaggaaatctttattcttaacaatgtccctgcagatgtcgcagtcaacgccatccagggcagcaaccagcttatcggtagcagtcccgttcagtgcgccgacgccgaatgtatcaagccattccttgcaggctgccttcatctcttccgtagccttctcattggccatgacgctctcaaccttggcctttaagccgtccctgatagcgttctgtgccagcagcataccataaccgaactcagcgttatcctcgaacagggagttgtcccatgcaggtccctggcccttggcattcacggtgtatggtgtggatggtgaggagttgccccagatggatgagcatccggttgcgttggcaatgtacatcctgtcaccaaacagctgtgtgatcagttttgcataaggtgtctcgccgcatcctgcgcaggcgcctgagaattcaagcagaggctgcttgaactggctgcccttaacagtggtttccttaaacttggcaagaacctcttccttaaccggcagtgtctgaccgaagtcaaagatagcctgctcgccaaggttagcctcaaggccttccataacaagggccttgttgcccttcatgcctgggcatacatttgcacaggaaccgcatccggtacaatccagggcggaaacagtgatggcaaacttgtagcctggcatacctgtcatatcttttaccttcatgtctgcaggtgccttggcagcctcgtcagcagtcattgcaaccggacggattacagcatgaggacatacatatgcacagaagttacactggatacagttgtcaggattccatacaggaaccttaacagcaataccgcgcttctcgtatgcggatgaaccggatggtgtggaaccatcaacgtaatcagagaaagcagatactggcagggagttaccttcctgagcgcttaccttggtctggatattgttaacaaagtcaactacatcctttcttccctcggttacaacagcgtagtcaaggccttcgtcctcacagttcttccagctgtccggaacctctaccttgtgcatgcccttagcgcctgcatcgatggcagcccagttcttcatgacaacgtcctcacccttacgtccgtaggttgcctttgcagcagccttcatcagctcgttggccttctcagcaggaatgatgccggtcagctcaaagaatgcggactgaaggatggtattgatacgtgtcgggcccatgccggtctcgataccgatcttaacaccgtcgatggtgtagaagttgatgttgtggtcagcaatgtacttcttaacctggcctggcagatgcttctcaagtccttccatatcccatgggcagttcagaaggaatgtgccgccgtcaaccagctcctgaaccatgttgtacttacgtacatatgcaggattgtggcaggcaacgaagttagctgtacggatcaggtaagttgacttaatcgggctgtgtccgaaacgcaggtgggacatggtaacgccgcctgacttcttggagtcatagtcaaagtatgcctgtgcatacatgtctgtgttgtcaccaatgatcttaatggagttcttgttggcaccaaccgtaccgtcagcgcccagaccccagaacttacagttggttgttccctctggtgtggtaacgagaggagcgccgacttccagggacaggttggtaacatcatccacgatacctacggtaaacggggactttgtcgtgttctcatatacagcaacaatctgtgccggtgtcgtatccttggaaccaaggccgtaacgtccggtcaataccttaacctggtcaaacttgcttcccttcagggctgcaacaacatccaggtacagaggctcaccaacggaacctggctctttggtcctgtctaatacggagataaccttaacggtatcaggaatcgcatcgattaaagcctgtgcgttgaatggcctgtacagacgtaccttgacaacgccaaccttctggccctgttttaccatgtaatccagggtctcctcgattgtatcgttaacagaacccattgcaacgattacgtgctcagcatccggagcgccgtagtagttgaacagcttatagtcggtaccgatcttggcattaaccttgtccatgtactcctgtacgattgcaggaagtgcatcgtaatatgggttgcatgcctcccttgcctggaagaagatgtcagggttctgggcagatcccctctcgcagggatggtttggattcagtgcattcttacggaatgcatcaacagcgtccatgtcaaccatttccttcaggtcatcgtaatcccaggtctcaatcttctggatctcatgggaggtacggaaaccgtcaaagaagttgatgaacggaaccttgcccttgatggatgccatatgtgcaacaacagtcaagtccatgacttcctggacgctggactcacacagcatggcgcatcctgtctgacggcatgcgtaaacatcggagtggtcaccgaaaatagataatgcgtggcttgcaagtgcacgtgcagatacgttgaacacacctggcagctgctcaccggcaattttgtaaaggtttggaatcatcagtaacagaccctgtgacgctgtgtaggtggtagtcagcgcacctgctgccagagaaccgtgaacagcacctgctgcacctgcctcagactgcatctctgtaatctgcacttcacgaccgaagatattggttcttccgtctgttgcccactcatccgtggcttcagccataggtgaagatggggtaatcggatagatagccgctacatcagtaaatgcatatgaagcatgtgctgctgcatggttaccatccatggttttcatttttcttgccattttgatttcctcctacaaatagtgaatatgtatatgtaatggtatacatgtgagtccgcctccggggcatgaagccctatgcagactgacctgtctactattatagcaattatttaacaaattgcaaatgcttaatcgcaattactccaaaaaatacaatgtaattcattaaaaaaatataaactctcacaataaaagaggggctgcttttcacagtccctcctgatatggccatcatcaattttctgattgtcatcccatcaattctggttcagcggcgcaatcacaggattgcctcctcccggtccgtccgaagcacctgggtcagttcccggccccggagcctgggttcccggtgccgaaggcgctgtgggcgccgttgtggcgcttggcacggtaggtgtgatgccaggtccgctttcctgggtggaaccctccggtgacgatatggtcgggtcactgcccggaacatagccctccggcatcccgtccacggtcgggattggtgtttcatccggaaccgtggtctcctccggcgccaggacaacgcctgatgtgttgcgcaggattacaggcgcatggcctttgtaggtggttttgtggtccagttccctggatacttccacgccgtccttatagatgaccttgtaggtctcccacctgctgcccttggtacccgcgctctttggtacctccactcctggctggagtgtctggtcttcctgataggtcggtgcaggcgggtccagttcttccaccttcttggattccaggtccagcttcatcccttcctccatgattgggattccgtaaatggaaaccgtcatcttctggtccgcgtagctggccttgatgccgatggatgtgctggaggtattcttaaagcggaaatccggctgttcccagctcacggtcgcatcctgtcccggtgtgatatagttcggctcaaaggtgtgggaacgcctgaaggaaatgctctcctcccccagtcctgaccggtataccgcattatagagggtggtggatacctggcatacgccgcctccgatttcctggaccacttccccgttattgtaagcagccgcacccttatagccttttgcctctgtcctctgtcccactgcctggttaaaggagaattcctcccccgggtggaccacggtgccgtttaaggcctcggatgccagccggatgttggtattacggtccttgttggcggttgtcttggtggtaaaggtgctgatggtcttatacttttccttggcagcggaagccgtgatatcaggagcggtctcgcttcccgttgccttaatctgcgcgtcaaagtttttatccttcagggccttgacgatatccccggcaagcttatcctggtcaatggcaaagccattctcctcacccttgaatacaaattctcccttttccttatcataagaatcgatggatccgttctttgccttcttatcccatctggaagcgcacgcagcagcctcttttgcagcggcctcttccatcccatccatgttaagggtatagctttcttccggatccccgctgtagatatcgtctaacagcgcgtctactttttcagccacaaggtcggtcaccggataggaatcatccccgtatgtaaccgtcatgccccaggaatactccttcaaaatagcgttcctggcctggtttttggacataccggttatggttatcccatccaccttaacctctttcatcatctctggttccgaggtttccgtgacctgcgtctcatccggttccccaaggctgccctttgccttaatcacaagggcaatgcatgtgataagcaccaggaggatgattccgatgactgctatcttcttataatcaggccccttcttccttctgtgggtactgttacgcctggcattatgggccgcgttcatccttccggcctgtcctgaatggtaggaggatgacccccgggaacctccgcccccggaactgctgcgcccggaacttctgttggaatagtttccattgcctctattattggtaaccttgccgcggcttctgcctgcagaagggtttctacgttcacggttattctctaattgattcattttcttcacccatcatttcatctagcatattattcacagattgtagtataacatactttatgtaaaatggaaccgtcttttttgtttttttccagccaattttacttattatgaaattcatgttactatatataaagtaagtattaggaagttattaaaaattggttacatctggaggttttaccatggattacgtggatttacatgttcactcaaacgcgtctgacggcacctgtaccccggccgaagtggtggggcttgccgcgcaggcagacttacgggccattgcactgacggaccacgatacgacggccgggattcccgaagcccttctggccggggctgcctgcggtgtggaagtcatcccgggcatcgaggtatccagttcctataagggccatgagatccatatcctgggacttttcgtcacggccggcaaccctgccctggaagctgtcttaaagcagttccggctgcgcagggaccagaggaatgaggaaatgttccggcgctttgctgatgacggcatcacctttacaccggaagaacttaacggcggcaatccggataccgtcataacaagggctcacgttgcaagggcacttctctccaaaggaatgggccccaccctggaccagatattcagaaaatatcttcagtatgacggcccctactgcccgcccaaagcatatgttgctccggatgaagtactggatgccctcttatccagcggcgccttccctgccctggcccaccccttccagtataagctgggtgacaaggggaccatggaactggtcggatacctgacatcccttggcatgaaagggctggaggtctaccactcctccaacaaccgtctggaaagcatgaagcttcagaaaatggcggctgcctgccacctgcttcccactggcggttccgacttccatggcagcaataaaccggatatttccattggccgcggccgcggaggactgagagtatcctccctgctgttagaagatataaaaaaagcattgtaatcccttattttttattgaaaattgtaattgttttggggtctgaattttgatataatcatatatgttaaaagattaaccagacttttccagatttggaaaaggactactaacaggaggaattgccgtgaagattcagaacattactgatgtagaaaagttttttgaagtagtagaccagtgcaagggaacggttgagctggtatcaccggaaggcgaccgcattaacctgaaatccaagttggcccagtatctgtcaatggctaccatcttctccaatggatatatcaaagaattagacctgattgcgcacgagaaggaagacatcgaacgtttaattaaatacatgtaccagggagaataagtgatataagaaacaggaaaccagcccgtgactgacagtcagtcatgggctggttttttgtttcttatggcatccctgcctttcatgtctttcctgatatccccactatttggcggactggtcttccggccctgctccggcctccccggcagacgcctgggtcacaggccctgcttttacagccttgccctttgaccgtcttgtccgggccgccttatccccgccggtcctgcttctgcttcccggcttcggcctgttaagccgtccgttcacctcatcccttaaaagggcataaagcacggagcagagagggatgaatatgagcatgccggcgattcccatcatgctgccgcccagcgtcaccgccaccagcacccagatggagggaagccccacggaattacctaccacataggggtaaatcaggttcccctcaatctgttggagcacaaagaagatgatggtaaaaataagcgcatccatgggctccaccatcagcatcaggaacacgcccacccccagcccgatgaacgcgccgaatatgggaatcagggccgtaaacgcaatcagcaccccgattaacagggcatagggaagacgtcccagggtaagcaccacaaagaacatggttccaaggatgaccgcctccacacactggcctgtaaggaaatttgagaatgtccgctcagtaagggatgcaatctccacaatgcgccctgtcacggactcaggaaggaaggccgacagcagtttcctcatctgccgtcccaaggtctccttctgaagcaggatatagatggcaaagatgaaaccaatcaggaacgaggatacaccgctgacaatggataccgctgccgagaatgtattgttaagcatggtgcctgcccctgttttcaggaatcccatcatgtcctggaacacctgctgccagtccacctctacatggttgacgtaatccagtatctgcggaaaactggcaaaaagctgttccatctcatccttcagccctgcgaaaaacagggggacgctggactgaagggtcaggaatgtcttaagcagctgcggtgtgaccacaaaggtaacaaggaacaggatgccggacaccagcagaatcgtgacaaccaggctgattggccgtcttaaccggctgtcttcccggaacatgatcaggtggcgttcaatgttgcgcatgggtacgtttaagataaatgcaatggctgcgcccagaataaagggccacgccatgtggaacagcgctgccgccacgtccaaaagccgtctgtaattgattcctgcgaccaccacaatgaccgtaaacaggatcagtcccctgagttttttaattgtctcctgatttaattccataataccatcctttatgattttgtctcttcctgaaacacatccgcaattgactgtctggatgcccggaaggttccctgggccatcaggctgctgcctccgccccttccatgaagtttcccattcatgtccttactgagggtccgcatatccatggagctgcttcccagggcatactgatactccccttctgtcccattgcctgaacacaccattaccacactgccctttttctgctcataaagcagggtggacaaccggcgtatctgcaccatgttaagcccctcctcaaaaatggccaggggactgctgctttccggatactgtcctgccctcagctccaacagctgaccatacaggcggccaatctccatctccctgtcctggcagtcatttttcagtttttcaaccgcctcaggcaccagatgcagtttggcggacagcaggttggacagccgtatcccatccttcagccgctccctgtaatccagaagcgccctgcggccgcacagcatggatatgcggaccccgcctttatagcggatcatgcctcttatcttaatgatacccacttctccggtattttctacatgtgtcccgcagcaggcgcagacatccccgccgggaatctctatgatccttacctgtccgctcagttccttcttgctcctgtaatcaatggatggaagttcctctttggagggataaagcgtatgtaccggcacattgtcataaaccacctggttggccgcatcctccagtccgtccagttcttccgctgtcatgacaccgttgaaatccacggtcacttccccggcgcccatgtggaatcccacattatcatatccgtaacgcctgtgcaccaggccggacaggatatgctcccctgtgtgctgctgcatattgtcatagcgtttctgccagtcaatgaccccctctgccaatgttcccggctcaaggggggatgccagctcatggaggatttcatcccccttttcatggacagatagtaccttcacctggttcagggtccctgtatcagagggttgccctcctccctcaggataaaacccggtctggttgagtacggccagccaggtccccttaccgcttgcttcacagcgctccaccgtacacatgaaagacttcacatagggagtctggtaatataatctgctcttgtccattttccatcaacgcctcatttcttcaatgcttccatgattatactatagattgacaggatgtaccatttaaaattttataaaaatattttcaaaaccaggaaacatgagcaagcagggggtcatatgataaagtgtaattaaactttatatggaggaactaacatgagtgatgtagcagcaacaaactgcggttgtgactgtggatgtggatgtggaacaggaggcagcgggtgcaatatcatctggcttatcctgattctgtgctgctgtggcggaggcggcggatgcttcgaccacaataactgcggcggcggttgtggatgcggatgcggaggcggaagcggatgtgactttatctggatcatcctgcttctgtgctgctgtggcggcggtggcggcttctgctgctaatgcctgtctctgagaatccttcaccaaagatttaaaaacggggagtggttttgccactccctgttttttattcatttaacagggtccgtgcctggggatgggctgcctgacgcggcgcttccccggtttttcccaccataccccttccttccctgccttctcctgacacactcatcatctatttcatacactgcattcccttcaattactaaacggttatacatggatttcactctccttccatattaataatatatgcagtgtccaggctttggcgcattcatgcttaaatatatggaattgtttgccaatcacctgcataagcttaaagcaaagaaagaaaaaggccggtggaaagatatgaacccatctgatgactataaacttactgatctggattatctcataggggaccaccacctgcagatgataaaagccgccctcccgtacctgggggtgtctgcgcagaagaccatatccctctttgtcaaagcacaggagctgagaaagaccgtggaactttttgagacagaagaagtggcttccatgggcatatgttccctggaaagttccgagcggaccggttctgtccgggacctgctgcaggctgtccgtccctacggcaaccccatggagcaggatatgattgacatggcccagacactgatggaaggccagacccccatggaacagcttcgcaggttccttaccccggaacagcagtcccgtttcgaaaccatggaaatgataatgaccgccatgcaggccatgtcctgacaacttattcattcagaaaggatacatatttatggatactaactggaaacaggatcccagactaaaggccatgagcaaagaaaagctggatctgctgacagaatttgccgagcgcattgaacacacaaacaaaaacaacctgatggagacattcatgtccatcaatatggaagccagacaaaaaggaatccagttcaatgataaggagaccgccctcctggtcactatcttaagctccggcatgccgcctgcggaaaagaaaaaactggatatgctgaaaatgatgtcaaaaaaactggcagggccgcgctgacacagcgccccctgccttccaaagcatgttccggaccaaaaccatccccggaccaaaactatctccggaccaaaactatctccggaccaaaactatctccggaccaaaactatctgagactttccagatttcctgcaatcacgatccttgtctgcccggttgccgactgcaccagttcctttgccctggcctccggcagacggatacagcctgcggatccattgtccgctgacgcagtaaagcagtggaggaaaatagccgatcccttcccaggcacacagtcctggttataatccagggcaagggcatagtcataatacggcgatgcagccgccaggttctccgctgaattccatgtcctgggggttgtggacgtattgaccagcttattgtaataagcgctggcggaatcatccacccagtaatcccctttcacaatcttatgatatggcaggacactgcccgggtcatccttcaggccaaatgccatggtgaatccataggtgcccgcaggagtcctgccatccccttccgctttttcagaggtaattcctccccttcccacgatggaagcttccttccacaccaggttccaggtatcatccccctttttataatagtaggtatccgcgttgcagccgcctgtcccgaccaccacgatcagctggtccgcgccctcggctcctgtcaggttgtggggctgtatcacgccgtccaccaccgcaggccctggtgtaatccctggttcaagggccgcgcccatgccggatacacccggtcccttctcttctgcctgcaggcggtatcccgccgtaccgcgcagacctgccttcaccgtacgcaggtccggctgtgccgcccatccggtcactgccagggccgccatgatgcctgccgccagggccgtcgctgccatccatccatgttgtctcatatgtagtcacctctgccttattttacttccatcattataacccgcacccgcccgtatgggtatttcttttttcttacaattatcagaaaaagcgcacagcctgcaggactgatgcgcttttcccctgatatggagcttatttacaaacaatgttgatgatcttgccgggaacgtaaatctcttttacaatgctgccggacatcttatccctgacagcttccctgcccgctgccagggcatcttccttggaaatgtcggcagccacattgatgatggcacgtgtctttccgtttacctgcacagccacttcaatctcatcatccttcatggcttcctcatcgcactccggccactgggaatggaacacgctgtccgtgccgcccaactgctgccacagttcctcgccgatatggggtgcgaatggtgccaggagggtaacgaaggtccttaaggtctctttatcaatgccgccctctttcttagccaggtcaatcagcttattgttatattccatgaaaccggaaataaccgtattcaggctgaactggttaaagcggtactcgatatcgtataccagtttgtggcgcagcttgatcatttccttagatgcctggatgtccttgtccttgttatccatcacaaggttccagaaacggttaaggaacctggaaacgccttcaatgccgcggtcatcccactccgcatccagttccggcggtcccacgaacagctcgtagaggcggagtgaatcgcatccgtaatcccttaccagatcgtccggggataccacattacccttggacttactcatcttgataccgttcttaccggtaatcatgccctggttgaacagtttcttgaaaggctcatcaaaatcaattgccccgatgtcgcacaggaactttgtatagaaacgtgaatataaaaggtggagcaccgcatgctctacgccgccgatatacatatcaaccggaagatacttgtccgccttttccctggaaaccagttcctcgctgttgtggctgtccacgtagcgcaggaaataccaggaggaacccgcccactggggcatggtgttcgtctcgcgcttcgcgggagcgccgcagacaggacatgtggtattgacccactcgtcaattccggccagaggtgactcaccggttccggtgggctggtaactctccacatcaggaagccttaagggaagctcttcctccgggaccgggacacagccgcacttggggcaatggatgatcggtatcggctctccccaatatctctggcgggagaatacccagtcacggagcttgtaattgaccatcttatggccaaagcccttctcctcaatcatgtggggcgcttccttcttaagcacggaagattccatgccgttccagtccccggaattaatcatgataccgcttgcctcagtataggcctcggtcatgtcctcaatctcaacgccgtcctttgcaatgacctgtacaatgggaaggccgaacttcttagcaaactcaaagtccctgtcatcatgggcaggcacacacatgatggcgcccgtgccgtaatcagccagcacatagtcagacagccagataggcgtcttctgcccgtttaacgggttgatggcgtaactgcccgtgaatacgcctgtcttttcctttgcctgcatacggtcaacattggaacgcatggaggaatcaaagatatacttctcaacctcttcccttgtatcgtccgtggccaggctcttagccagctcatgctcaggcgcaagcaccatgaaggtggcgccgtaaagggtgtcaggcctggtggtgtacacggtgattttctcatcgcgtccgtcaaccgggaaatccacctcagcgccataggacttgccaatccagtctgtctgcattttcttaaccttctcaggccagtccagcttatccaggtcatttaacaggcgctcggcataggctgtgatcttcaacatccactggcgcaggttcttcttggtcacagtggtgccgcagcgctcgcagcagccgtttaccacttcctcattggccagtcctgtcttacaggaaggacaccagttaatggggaactccttctcatatgccaggccctttttgaacatctggacgaaaatccactgggtccatttgtagaattccggatccgtggtattcacttccatgtcccagtcatagatggctgcaatctgcttgatctgcttctttatattggaaatattggcctccgtggacttggcaggatggacgcccatcttgattgcatagttctcagcaggcaggccgaacgcatcccatcccattggatggatgacatatttgccctttaacagctggtatctgctccatacatcggagatgacataccccctccagtggcccacatgcaggccgctgcctgaaggatatgggaacatatccagacaataatacttttcttttttgccatcattgacattgatgggcttctcttcccagttctcccgccactttttctctatggcgctgtgattgtactgtgttgccatgatttcattcctccattggttattcaaggttcctatgaaataaaaaagccctgcgcctctactgctagagacgtggggcttaaatcctcacgcggtaccactctggttcatgctcatgcatgcacttattcctcttataacggtaaggtctccggcctgccctactgaccctgacccccgtgtgtccggcagtcttatgttggggcaagctactccagggccagttcaataaccttttgtcaccggctcgcaccatccgccggctctctgtatccatccagttacctactactccctatcagcgtatttacactgattcttaatttagcatatttccgaaacagtgtcaaccattaccggtgaaaaaactgcccggacgtcatcccggaccatgccgccttataggctgtcttggcatgcctggcttccctggaacgccggattggcctggcttccctggcccatttggccggagtctcatatctggacggctgggccgggcctccaatccgggcttcctccgtaaaaaaaacgcaaagtccgtccaaatccctgacccatcccttttcaaaccagccatactgggttccgtcaaacccgtacactgcgtccccgtgtatgtaggccgcgggactgccgtcaaacaggtagatgtgttccccgtccctgtcaatataggctgccggcacgcctgttctttcatataatgtcatgtatcgttctccccgtatctattttccgattccttcccttctgataacaggtatattatagagggaatgggtatattatacaactttaccgtatctggttcaatccttgtcctgcagtgaataaagaaatttatcaaacgtgctgatgtctgattgtaaagtgtctataaagcgcccaacatggtatccgtcagtagcagcgtgatgacaggttagattatccatgcttatagctccatataaaataatccatgttggttacagtaccaaagtaatctcccatgaccagaaacaggaatacgcacctgcagtccccattcagggtattgtctcttaatcaggatactgtcccctgtcagcagtgccacaaatacgatataatgttcacgttccattgcatggtcagccgtgatataaaaatcattttcaattctttctacatttaacttctcattcccatcggctttctgcggctgtaatgctttcatttttttaccgcagcaggatatgtcggtttccgtcattgcagtaaccatgtttccgcaattaggacacatataaaagtgcattttcttcatgttacctcccagtatctcgttagcgtccaattcgccggatagcagtttttccaaatcaacattaaagatttttgataattcgggcagcagtgataattccggacagcctagtcccctttcccacttactgaccgtcttatcacttatgttcatctgattggctaattgtaactgtgtcatacggttttcttttcttagctggtaaattaattttccaattttcacattatccatttttctctctccttgtccataattataaaactaaaaaactcatttacaataaacgctccgttgagttcaaaccatcttctgtccatggaaggtggacggtaagatgtaacagggcattccggaatagcctcttccagcattatgtgttataatcagaaataccctatgcggaaaaaggagatacaaatggatttacatacaacagtaagatatatgatcatgctcggtatcggaacgctcttttcattttttttgtttgtaatcacatctgcaatgatttttgcctggattgatggtgtgctttttgccgtcatcatcattctttgttttgtatttttgagatgtccgtattgcagcggaaatcttatgggaaaagtctggtgtgaatactgcccccattgtggcaaagagctggattggtaatgaatatttctgcacgtcaaaatcaaggaaggggttccggccaatccacaaatcttaacgcaactctaacactgcctcctattgcatttccgtttgtccctatgttaagctttaattgacgtatgcccttgatacataagttgtaccaggcatatcggacaaaataacggacaacaggaggtaacttattgaatcagaagttaaaagaaaaaatcacagaatccttatcatctgtgctgcccgttacctgtatcgtattgattcttgggattacgattgcacctattccgctggatccgctgatgctgttcctggctggcgcggccttcctgattataggtatgggatttttcacccttggtgtggatatggccatgatgcccatcggtgaaaaggtaggggcgcagctggcacgggcaaagcgccttccaatcatcatcacggcatgtatcatcatcggcgcagtggtgacggtagcggaaccggaccttcaggtccttgcaggacagacacccgccgtacctgacatggttctcatactggcagtagctgcaggagtcgggtttttcctggcccttgcgttccttcgctccctcttcggctggagcctttcccatatccttatggtctgctacatcatcctgtttatcatggctttttacattccaggtgacttcctcgcagtggcatttgattccggcggcgttaccaccggtcccatcacggtccccttcatcatggcccttggaatgggtctttcttccattggccaaggcaaaaaccaggacagtgacagcttcgggctggtggccctgtgttccatcggccctatcctctccgtaatgatacttggacttgtgtaccaatcctcttccggtacatatgaacccatgtccattccctccatcagtaactcccaggacctgtggctggcattccagcacgaactgccggagtatgccctggaggtatttacggcccttttccccattcttgcattctatatcctgtttcagattttctttttgaaaatgcgccgcaggcaggtggtgaaaatcctggtgggcatgctgtactcctacatcggcctgaccctgttcctcacaggcgtcaacgtaggcttcatgcctgcgggaagctatcttggcaagcagctggcctcccttccttaccggtggatccttgttcccgtggcaatgctgatcggctacttcattgtaaaagccgagccagccgtccaagtgcttaacaagcaggtggctgacatgaccggaggcaccatatcagaggcagccatgatgaaaggtctttccgtgggcatggccctgtccctgggattttcactgttcagggtacttaccggccttccccttttaagcctgctccttccaggttacgcgattgccctgggactgtccttcattgtccccccggtcttcacttccattgcctttgactcaggcggtgttgcatccggccccatgacggccaccttcctcctgccttttgccatgggggcatgtgaagcgctgggcggtgatattttaaaagatgcattcggtatcgtggccatggtggccatgacccctcttatcatcatacagcttatcggcctgtcttatgagtttaagacacggagggagaaaagcagcgcacagctgtccattattgatatggacagtgaatttatcgacttagggaaggaggaccccaatgaatcctaaccatataaaatggatggccgccatcgtagaccgcggcaaaggcaaccgggccgctgccattttccaggaacatgaccaatcaatcctcttgattgccaggggccacggaactgccagctccgccatcatggactgccttggtctggatgaaccggaaaaagacctggtcctgggtattgcatccgcctcggactcccatcatctgatggacgccctgaaaaatgaattggaattccataaaccaggccacgggattgcattttccattccgctttcaggaatcagcattgcggctttgggccgcctgaagaatcgggatgcgcgccagcatccccaccacactgccagttccaaggaggatacccctatgtcagatcataaaaactacgaattgatagcaactgtcatccataccgacctgtccatccctgtgatggaagctgcccggaaggcaggatgccacggcggcacccttgtgaaggcgcgtgaaatcggctccgatgaggaaaagaagattttcggcctgaccctttcccaggaaaaagccatcctcctgatcctcaccccatccatacagaagcagcctatcttaagggctatctgcgaaaccgtgctgcgggaaaccggcgaacatgcggttgcattctcccttccagtggatgaggtagaaggaatcagcggataaaatcataaggcctcttccaggtcggaaaaaatccagagtgtttcttttgggctgccggaataagtgctgaaatttaaaaccctcagctttaaccggcacccgtccttcttctcatatatgagttcaggtatgtcttctccatccagcaattgttccaggtacgtgtaatcacaaaactgtttgaaatcagggatgtacccggttttcaccatgcggccggcatagagcataagggccttgctgaaccgtccgttggactcttccagcatttccttaaaataagttggaatgaaaatctggcgcagcgtatctgtttccagattgacaaaatatactcccttaaatgcaggcgccaggacccgcatgaaccgctcggcatcccttttttcagctatgatccgctccatcttcctgtctaatatcctttgctggcgttctccccctttggaggaataatactcttctttgtttttctgcatatctgtttcagctgtctggatgatttcattgatatccagattggattccctccaatccagacctatggaaagcgagtattctgcctccccggcctccctgcatacatcctttgtccttcggaccgcttcatgatatgtaatgtttttacaaagcaccacaaactcatccccgccgatcctgaaaacctcatccggcctaaaatgccgcagcaggataccggcaaccgttttcagcatggtatcacctgcctcatgtcccagatggttgttcagttcatgaagtccgttggcatccacgtaaatgcaggtcagggatgcggcctccgtgtcaaccaaagcctgcactgcctttgtatagctgttcctgttctgaagtccggtgagtgcatccaaaagggcttccttacttaaaatcttattggccgcctcaatctgccggtactgcctgttgatggtcatctcatccattttggcctgaatcctggaattgtacaggcttgtattaatcacaattgccgccagggacaggaacaggctgttcataagattgttataaccgtgattcagtcctgccggattagggaaatatggcagcagcagattcagcagcaggaaattcacaaggaacagcagggctgtcttccacggcttcatcatggacattatggccatgattagtatcacataattataaaccgtcagcccgttcccacccagctggtcattaagggtaacggcaagtccccagaaactgaagaataccatgtacccatgctctatcctgaaataacagcggtggctgtccttttccctgccggcccacgcctgcccggccatcacacaggcggttgccaggatgagcaccagatacagcaggaaataggcggtccgcctgggtttcacaaatggtccgcccggccgcagggatatggagataagcatgatcagctcatatattattatgaaaagatggaaataaaaattcctgcccgccacactgacgtgaagtgaggcaatgatttcatcaaaatcccgggttccggaacccatgcccagaaccccctttaatcggctccacattaatatcatactccttcagtcatcgattacaggaaccatatatggatttcctgccattaaagtatatcataccttatattcctgtttctgggaacctgtttccacattcatcctcttccatttttcaggaaatacattataattattaatatcaaatgaaagcaggtgcaattgaatgtacataggagatttacacatccattcccattattccagagccaccagcaaggacctgacaccggaatatctggatctgtgggccaggaaaaaggggattgacatagttgggacaggagattttacacatcccgcctggagggccgaactggcagaaaagctggaaccggccgagccgggactctacatcctgaagagggaacggatcatccgtcattcttccgccccaggaagccgccagccacgatttgtaatcagcggggaaatcagctccatctataagaaaaatgataaggtaaggaaggtccacagcctgattcttctccccagcctggaagctgccgagatactttccaaacgcctggaagccatcggcaacatccattctgacgggcgtcccatcctcggacttgactgtcatgacctattggccattacattggacgcctgcccggaagcaatctatgtgcctgcccatatatggacgcctcatttctccctgttcggggcgttttccggctttgacaccatagaggaatgctatggggaactgactccccagatacatgcgctggaaacagggctttcatccgacccctccatgaaccggcgcctgtcggccctggattcctttcacctgatttccaattctgacgcacactcgccggccaagcttggaagggaggccaacctctttgacatccccatgtcctatgacgggctttacggggccatccagagaggcgaaggactggcgggaaccatcgaattcttccccgaggagggcaagtatcactttgacggccaccgcaaatgccatctctgcctgagtccgtcccaggccaggcaatacaacggcatctgccctgtatgcggcaaaaagctgacaacaggcgtgctccaccgcattgagcagctggcagaccgccgggaagatttcatccttccgggcggacgtccgtatgaaaaccttgtcccgctgccagaggtaatcgccgcatgcatgggctcctcttctgccagcgtcaaggtaacgcgccaatatgagcacatgctggaagaactgggcagcgaattccatattctccgaagcgccaatctcgacgacatcagccggatcggcggacagcttaccgcccagggaatccgccacctgcgggaaggcaaggtggactggcgcccaggatacgatggggaatacggcaccatgaaactgtttgcagcatcagaactggacagtgtggaaggccagctgtcattcctgctggatgacaatgaaattgaaagcttcaccagccaggccaatccggacggaaacgctgcttctgctggccaggccgtcccggacgggcacgctgcttctactgaatatacggttccaggcgggcacaccgcttctgccggacatacggttccaggcgggcacaccgcttctgccgggcatacggttccgggcggacacgctgcctcctgcaaacagacccttcctgcctcacaaaccggcgcagatgtccttgacggcctgaacccgaaccagcggcaggccgtagggtccataagccctgtaacagcagtcatcgccggacccggcaccggaaaaaccaagacactggtatccaggctgtcctatctgataggtgagcgcggtgtcaaacccgctgaaatcacggcagtcacattcaccaataaggcagcagaggaactccggcagcgtatccgccgccagctgcccggcaagcgcagcttaaaccagatgcaggtaggaaccttccattccctgtgctaccgcatgctgcaaaaccaggggacgggcctgtccctggcagatgaaggacagcagcaggaatgtgctgcgcaggtaaccggacagttaaaccttcctgtttcccccagccagttcctatccctgatatccctgaaaaaatccggtacaggaaccataccggccccggccggtccttcggatgaagacgggaaaagacccccaaccctgacggaagaagcattttccagatacaatgaacttcttgcctccaggaacctgatggattttgacgaccttcttctaaaggtattggaacttttaggatcagaacaaaagctggaactgcgcagacagcacttcttctacctgctggtagacgagttccaggacatcagcccggtacaataccgtttaatcaaggcatggaacaaaggcggaaaagaattattcctcatcggtgacccggaccagtccatctatggtttccgcggttcccagagcaactgcttcgaccagctgtgcagtgattatagccaagcctgcgtactgcgtctgaagcccaactaccgctccacccccgagattctttcagccgcccttccgctcatatcccacaaccctggagagccgagggaactgacccccatgctgggccacggcgcgccggtccgcgttgcaacagctgaaagcagtctctcagaagccattttcattgccaaggaaatcgggcacatggtcggcggcattgacatgctggatgcgcatgccaacacatcagcaatgactgatacgccaagaagcttcagcgatatagccatcctataccgcaccaaccatcaggcccgccttctggagcaatgcttaagaaaagaaggaatcccctatgtggtagcgggccgcgaggattatctgggagagccgtccgtacagggcaccatctgctttttccacggaattgcatcctccttaccggacagcgaagaaatctggtcccacacaaccagcctctgccgcaaactgctgggcccctgtcatgactacgaagccctgaaagcacaattcaccaaaagactgaagcgtgagaagccatggaagctgctggaagactggatgaaaatcctgaacctgacagacaacagatccatggatacctttctgtgcatgtcttatttccacaagaccatggaagacatgctcaccaccctgaccttcggccagggcaatgacgtaaccagaagcggccaggactcctgtccctccagcgcagtaaccctcatgaccttccacgcatccaaaggcctcgagttccccaccgtattcctgtacggtctgaaacagggcctgatgcccctaaaatcaggcagcggccctgtaaacctggaagaagaacgccgtctcctatatgtagccatgacacgcgccaaagaggaactgatcatcaccacctccgagtccccctcttccttcctaagcgagatacctcccaacgccttccgcccggaacaggcacgcaccccagccagcggaatcaaacagttaagcctgttcgatttcatgaattaacacccccatcatcttatccatatatccttaaccatatgcccttaaacacatcttctcaatatatgaaaaagcagcagccggaagccccagcaacctcttcatacctcagcttcggagccaggggcgggagtcaggcgggcttgcggttccttgtggagggtgtatggtctgcttgctcaaaaaggcagcaaaaacagggtcgagtgagggccaccaagcccgaacgcagagcgcctacggaagaaaaatcatcaagatttcttctgtagttggcgcggtgccctgattttgctgtctttttgagttagcagaccatatgcccggaaccaggaaccgcaagcccgcctgactcccgcctctggttccgggaacaccaaaaagcagaggttgcgtaactccgccgctccccctgctttttcaaaatccctacctatcttccatggccacataatccatattatcgcccacatacttagtcgcaggacgcatgatacggccatcatacagcttattctctatattatgggcaacccagcccactacgcggctgcatacaaagagcggcgtatacaaatcccttggaatccgcagcatcccatatgcaaagccgctgtagaagtccacgttggtgggaagggccttgccctttatctcctccatgacttccttggcaatgcgctcgaaccgcatataataatccagctccttcatatggttctgctccttggcaacctccatgcagcaggcccttaagacctcggcacgggggtcggataccgtgtaaaccgcatgaccgaaaccatataccagaccagacctgtcatagaggtcgcctgacatgagtttcctgacggcctgacggatccttgaatcatccgcgtcatagccgcctgtttcctccaggaccgcatccatcatctcagccaccttgatattggcgccgccatggcgcggtcccttcagggaaccgataccgccgcacacggtagaatagatatctgttccggtggaagcaatcacaacattggtgaaggtggaattgttgccgccgccgtggtccgcatgaagcatgagtatggtatcgaggaggcttgcttcctttgatgtgaacttctggtcctttctcagcaggctgaggaaattctcagcaatggagtattccggattggcatagtggatgaacaggctctccctgtcataataatgcaccttgctctggtatgcatagcatgcaatggagggcagctttgccagcaggttcacgccctttaccagggtctggtatacatctgtattatccggatcgtcatcatagttatagagggtcaggaccgcgtccatcagcttgttcatcaggttcttgccgggaaggcgcagcaggttcatttccacgaattcatccgggattgtataacagcgtcttaccacgttacagaatttctccagttccgccttcttgggaaggtatccgaacaacaacaggaaacatacttcctcatatccaaaatggctgcccttcttaccgttaaccaggtccagcacatcgattccgcggtaaagcagacggccaggaatggccttaatcccttcctccgtctcctcatagccgaccacgtccgccaccctggtaaggccaacacggacaccggttccgtcctcattgcggagacccttttttacattgtattccttataccacttattggggatatctgtataattctgggacttcccataaaactgtgcaagatagctttccttaaccattgtcattactcctctctaagaccagtactggaacacagtaccacctacgcctgccaaaccaatcctctatcagtgtctgccccggttataattaatcaggcagcctgcctttacaatctcacgttcctccgcggtcatatccgtaatatataaatccagtgtctttaccggaacttccttttccccgtccccaaggacatatgccttgatgttctttaaatccccgtcaagggtagcacggacgccgggaacatagatgtaatcccctacttcaaactcaggatctgcctccatctggaaggggaccattccccagttcatcacattggaacggtagcgcttggttgcgaattccttacatatattggcaaggcctccgataacccgctggcagctggcagcctgctcccttgcagagccgtcccccggcttcactgcataaatcatgctgccaatctccgtatcctttaccgtcacctgttcattgccctcaatctggttgatggccttaaatatattcttaagccttggctccagctccagttccctgtcagcgccttcctgaacccttgctttctctaacttatccacttcctttgtgcgtcccacatactcagggtcccttctggaaagggtaaactctgccagtcccagcggattggagcggtaggaggaagtctcgccggatggaatcagttcatcggtggtggtcaccgggtccatgatcttggaacatacttttagaaggatattgtctgccagggaactcatctccggccagtccttaatgttcggaccgtagataaggtccttatccgtattcccgctgccataccccatatacacacggttcttataggaaatgtcgtcaaacccatattcaggcacattgccccagcagtccatctcccaggcagaggtaagcctgcctccgttggccgcggtggcggcaatggaacgtgcatccataagcgccactgccgccatctgtccgttccctggcttggaaccctcccggttggggaagttcctggtggtatggcggatgctgagtccattgttgcagggggtatccccggcgccaaagcatgggccgcagaacgccgtacggatgatggctcctgcatccatcaggtcagacacagcccccttcttcacaaggtctgcgaatacaggctgtgaggacgggtatactgccagtgaaaattcatcgcagccgcagttcctgcccttcagcgcatgggctgcttctattacattgctgtaggttccgcctgcacagcctgcaatcactgcctgctgtaccatcagtccgccgtctatcactttgtcaagaagggtaaattccgccttgccgcctgatatcctggcggcttccttctcaacgcctgcaaggatatcctgcatgttggccttcagctcatcaatctcatatgtattgcttggatggaagggaagggcaatcatgggctttaccgtggacaggtccacataaacacagccgtcgtaatatgccacatcagccggggataactccttatagtcctctgcccggttgtgttttgcaagataatccctggtatcctcatccgtcttccagatggagcttaaacaggtggtctccgtggtcattacatcaacgccgttgcggtaatccgtgggcatggaggcaacgcccggtcccacaaactccattaccttattcttcacatagccattcttaaacacggctcctatgatggccagggcaatatcctgaggtcctgtgcccggacgcggcgccccgtcaagatacacggcaaccacgcctggataggccacgtcatatgtatcccgaagcagctgctttaccagctcaccgccgccctcacccactgccatggttcccagcgcgccgtagcgagtgtggctgtcagagccaaggatcatcttcccgcagcccgccatcatttccctcatatactgatggatgaccgcaatatggggaggcacgtaaatcccgccatacttcttggcagcggaaagcccgaacatgtggtcatcctcattgatggtgccgcccactgcgcagagcgtgttatggcaattggtcagtacgtaaggaatgggaaactgctccataccggatgccttggccgtctgcacgatgcccacaaaggtgatgtcgtggctggccatgctgtcaaaacggagcttcagatgttccatattatcagatgtgttgtgtgcctcaagaatggaatatgcgatggttcccttcctggcagcttccttatccgcctccctgccggtcagggccttcactttcccgctttctgcttccggaacaatctccgtcccatttaccaggtaaataccgttttcatataatgataccatttcctttacctccggtcttatatattttacaaaaaagggccgcactgttcatggcgcatgcccctttgccttcattgtttaatactataaagcaaaattttcgatttgtccagcttttttactgtagtttccacagcttttatattgtggttcattttatttttcacatgccatttactgtcacccattacagctttatcactgcaaagtggcggtataacctaccagttcatgacaaaaagactgatgcacacaagaaaataaagaatcatgcccacatttaaaaccactgtcttgaaacgtgtgccttttttaatgggccatgtcccaggttcaaggtgaatctgtctgcggtacaggatcaacagcacaatacctcctacaagacaggccaccatgaacacaaaataccctaccatgagaaagcctgatacggcggctatgacagcgctaaggtccactgacagcatccgttccattccctgaacgaaccaggagccgtcaaaggccccgctggcgcctttggtcagttcaactgcaatggcgccgcccaaaagattaaaaatcatgtggaacgcaatggtatagcccacctttcccgtcttggcatatacataggcccacaggacgccgattccaaaagcatagaagaactgggagaaattaccatgggccatcccgaacataaggcccgacataaggatggccggtccttccccataccccagaagccggtccatgagcagtttcctgaaaaacagttcctccacaaccggggccatgagcacggtgaacagcaccgtcatccacactccggaattcatcagcagttcgttcagctggctgtcatccacgccggaaggcttgaaccattccacaaactgccccagcaggttccctgccagcccgattcccactgaaatcacaaggcaggccgcaaacttaccgattccccagggctgcctctgcgcatggccgcatttaggaatcagctggatcagggccacggacacgggaaatgccacaaagtacatgggtatggcggacagtaggatgagtcccgccccgctgaataaatcaatgatcccgcctaacaggtagttaatgaaacccgcaaatgcaatcaccgcaatctgggccaggaatgtcactatcataaaagcggcagccaccagacccacatgggaaaactgccttctctgcctccttcccagcgcctttgcctcttcctccaattgccttgccgtgtagtcctcttcctgcatcatatgttatgttattttctccctgtgtgaatttggtatatttctgttgcaattgcaacagaaaagtattatgatattcattatcataccataaataatagcagggtaaaagagatgacagaatattttcagaaaaacttatttaaagatatatccatggaagaatataaaagcctgctcacctgcctggacggcaggaccagacagttccgggccggcgatataatatgtgattacgacaagggctttgacgatatcggtatcatcggcaaaggcagcgcctccgtggtccgttatgaattcaatggagccaggaccattctggagcggcttggaccccaggacatctttggccacctgctgtcctgtgacggaaatgaacacgcaggaatcagtgttatcagcgacagcgcctgcgatgtgcttttcatacactatgcaaccatcagttccccctgcaccaaggcgtgccggcaccaccaccagctgacccagaaccttctggacatgatatccgagcgcgcccttaacctgagccgcagggtggaggtcttatcccagcgcaccatccgcgaaaagctcatatgttatttcctccagctggccgggcaggcaaaaagttcctccttctgccttccctttaccatggtggatctggccgattatctttccattgacaggagcgccatgacccgggaactgggccgcatgaagaaggaacatctgattgagatggataagcgcagcgtacgcctactcctttagacacttaagccttctttcaaaaacatcaggggtctcggggcgcccaaaataaaagccctggatatgttccataccaagttctttcactgcctggtactcatctcctgactccaccccttccaggcacacctgcttgcccacgtcatggcacagttccgtgatggaacgtatgaaagtggcgttaaacagatctgacgtaatgcccttgacgaacccgcggtcaatctttacaatgtccaccggaatggtcttaagggagaacagggaagaataccccacgccaaaatcatccatggctacccgtataccggttgccttcatatcattcagcatcttcagtgtctccccgtccgctgttgccagataggtttccgtcagttccatgacgacatgggacggcaaaagatccagttccttaagcgtatcttccatatacggtatgatatcatcctctgccagctgtacataggaaagattgatgctcatctgaaaatcaggcatatacctgcaccactccctgcactgcgcggctgcatggcagaaaatccaccgtcccagatttatgatcatcccgctctgttccagaagcggaatgaattctcccggtgagatatccccatacttactgcaatgccacctggccagcgcttccgcgccctgaaggcttcctgtccgtgtgtccacctggggctgatagtggatggaaaaaccagcgaaccccctgtctatgctttcacgcagaagttcaaccagttccagccgccgttccctccggtcaaggatatccttggaaaacacggtcatacggttctttcccatcagcttggaatgttccagggagtagttggcgcattttaaaagttccaggtaattatccccatccttcggatacgtggtatagcctgcggagatggtacagtaatacttccttccgctgtattcctgctgtttgtggaatacctgctggattttggcaaaaatatcccagccttcctcttcaccgcagcccaagcacaggaccccgaactcatccccgtccagccggtaaagcttggcattggcaggaagcatggatgacaccttctgggccgtgatgcgaagcacctcatccccaaaggacctgtcataaaggtcgttgatgttcttaaaggaatccaggtccagaatcatgattccaatggtatccacctccgtgtggtccaccaggtacttctttatatcaccttcgaactcatatttattataaagcccggtcatatggtcaatccggttccgttttccaagattggtaatcatgcctgcaaacagtcccggggtcccatcctggtttttcaccatcttccccctgcatcgaagccatatccactcgccctttacattcctggccctgtattcaatgttgtggtaatcctccctgccatccgctatgttctggttgctttccaggaaatacgcctcatcatggggatggattaacccgccccagaaagcggctgcattcttcacaacctggccgggcaggccgaactcatcaaccatggcctggggataatggaacacccctgtgcccatatcacccacaaaaatataatcctccgtgctggcagtaagggcctggtaaaatgtctcgttgtcataatcaaagagactgcctgtcccgcattcctttccttcctttaacgcctccttggcgcggctgatgtgataatcccttttctgtatgtacatctgctcatccgccctggcgattatctcatcaatggaactgttttcccccggatatatctccgtaaggccatagctgaacggaaccccgtagtccacgtccaggcgttccctgtcctgtctggcccgcaggaggatacgcttcatgctttcctccacctctgccttgctccgtccatagaaaagcatcacaaactcatccccgctgaggcggaacatgaagtccagcctgccaaggccttctttggtaatggatgcaacataacgcaaaagcgcatcccctgcgctgtgcccatactggtcattcacacgcttcagttcatttatatcatacaggacaagggtaaggatctggttttcccgttccgcctgttcaatggtctgtaccagacgctcgttgccgcctctccggttaagcatctgggtcagttcgtccatacgcgcagaataaaacatcttatcatattcagtcacatccacggaattctgtatatgataaatccttccgttccaccggagcaggctgtcatagttctgataactgcgcccggtcagtgcattattctcacgccaggagctttcattgccctcctccccctttttcagaaggtctatgtggcagaattcgcaccgccgttccatccccttctccaggaccttccagcagcacttcccctccgggtcctcaagtccaaaggcctttttcatcgtttgattcatatacaggatctcatctgtctccgtatctgatatatagatattggagtgcatctggtccaggatcatggccagaaacgtatccttaaacagttttatctgctcctcagtcataaaagtaccctctctaccacgtaatgaagtctactttatattgtaaactcttcccagttcatactcaaggggaatttcacaaaaaaacacctctttccagtaaatctgcctgaaagaggtgttttgccctgtcttaaccttacaaatccatattactcttcaacttcagagaacatatccttcccaacgccgcagagcggacatacccaatcatccggaatatcctcaaatgctgttccaggcgcaataccgccgtccggatcgccaacctcagggtcatatatccatccacatggatcgcatacatatttcttcattattatttcctcctgtatttaaaatttattttaattcgtatttccttttgatgtgattaatatatcatattcattcctgtttttctgtgacatttgcaacacatattgaaattttttatattttatcacaatacctttattatatgcagttccagcccggcccatgcaggcaggatgtcattccgtacttatattttcatgttgccctgtctgccattccatgctgctgttccgcatgaaccggaaaaaacactgcccgcaaaatctgcgggcagcatgctttcatcacaacataccattccatctatggaccgtacaggtatacggctgctgcttattccccatcctttgccgcggccctggcctcaacctcacgcttctgcacatctccaggcgcctgctcgtaacggctgaactcataggagaacacgccgataccgccggtcatggaacgcaggtccgtattgtatccgaaaagctctgacataggaatatcagcctcaatgacctgcttgccattgtggttggaattcattccaagcacacggcctctcctgcggttcaggtcgcccatgacatctcctgtgaacttatctggaaccgtaaccttaagggaggcaatgggctctaagagcacagggccagcgtccatgaagccctgcttgaacgccaggatggtcgccatcttaaacgccatctcagaagaatcaacaggatggtaggaaccatccaacagggttgccttcaggccaaccaccggatatcctgccagcggtccttttaagacgcattcctgcagtcccttttcaacagccgggaagtagttcttcggcacggaaccgccaaataccttttcctcgaatacatagggtgtctctaagtcgccggacggctcaaattccatgatgacatcgccgtactgtccgtgtccgccggactgcttcttatgtttgccctgtaccttaaccttcttgcgcagggtttcacggaatgcaaatttaggtttggtcaaagtaatgtcaaccttataacggctctgaagcttgcttaccaccacatccagctgctggtcgccaataccatacagcagcgcctgacggttctccgcatcattgaccaccttaagggtctggtcttcttccatcatacgtgacagcgctgtggataccttatcatcctcgcccttgttcactgccttatatgccatatatgtgtacggagtggaaatctctggcttatggtagacaatcggcgccgtgcggacagccatggtatccccagtctgggtcacggtaagctttgcaaccgcgccgatatcaccggcccttaactcctggacctcaatctggtccttgccgcgcaggatatataacttgccgattttctcttccgtgtctttattcacgttatagacaaccgtatcgccttttaacgtaccggtacagatcttcatcagggagtatttgccgatgaacgggtcaacaatggtcttgaacacccttgcggacagggatacgtcatcattgtacttggcggtaaaacgttcgcctgtggatacgtcaacaccgatacactcaaaatggtcaggtgacgggaaatacttgtcaatggactgaagaagcaccttaaagccctggcagttgataccggaacccatcatgaccggcacgatctcgccttcaatcacatgctcgcggagtgcggtggaaatctcctcctgtgtaaactcctctcccaggaaatagcgttccatatattcttcattggtctcggcaacagcctcaatcagggcgtccctggcaatggtcaggttcttctctacatactctggaatctcacactcaacataatcgcttaattccgtgaaacggcgtcctgccatcttaaccacattgacgaaacctacaaatttttcattctcacggattggcagctggaagggtgcaatcttacgtccgaaacgtgtctccagctttactaccagttcacggtaactggcatggtcatcatccatattggtcacgaaaatcagcctgggaagcttgtacttttcacacatctcccatgccttttctgttccaggttcaatacctgccttacagttcacaactatgatggctgcatcagcaacactgatggcctcctctacttctcctacaaaatcaaaaaatcccggcgtatccagaaggttaatcttaattggcccgctctccccttcatattccaaaggaatcagcgtggtggaaattgaaaactgtctcttgacttcctctttgtcataatcgctgatggtgttgccgtcaggcaccttgcccatacgctttgtaacaccagtcaccagcgccaatgcttccgcaactgtcgtcttaccggcgcctccatgtccaagtaatacaacgttgcggatttgttcagtaccatatacgttcataaatttccctcctgtatataaaatttaagccatgcgtatattttactaaatttttctgattttttcaagctttttatgtgatttgcacaacattattctagtcgtacctgtcccattatgagaagcattgtaaaaacaaggaaaatggacgcatatggttcaagcttcgtatcccaatcatccaagtcccaatggaaccgccagaaggttaaccaggattcccgctgccagtccaaagaaagggtccgtaaaaacggttacggtcaaggcaacgctgctggcaagcgcggttcccggggctgcatctgcatatgctgcctgaaggtttgacggaagcgtaaggacagcccccagaataaacagggttcctgcgacggctgacgagggtatatatctgacaatcttcggcagctggcgcgacaataaaatgagtgccatgattgccatcataatgactgccgcccactttgcattgggagctgctgccgtgggagatatgacaacggaaatcggcgagcctccaaagagcgaggaagccgcatctgccagtccggaatagatggagatgtgatcaacattgacatcaaccccggaaatagccccgctcacctgcccaaatgcgatattacccccaatggtaatacacatcagcgccagggtcccgcgcagtatattggcgctgaatgccggcatctggaaggaaaacctatcttcaatttcaatatttttaaccgcattcccttttgaaaaatgatatgcgatggaggacgctgcaatcgaaaacaggcaggtatataccaaatccttggtgatgagataggacaggatccctacccccattgaaatgcttcccagcttatggtccccgcgtaccatgtccacggaaatctttgcaaggatcagccctacaccagccatcattgccgcagtcacatgtccacccgcaaacttcacgatgccctccaacaggcccaatgcacccaggacgctcatgccgatacctgcaaggattaccatggaaagcctttcgttccttgttttccccatggttccagccatggccatggtctccgcctgaaatgagatgggaacagcggaattaaaaaccacgcagcctgcaattccgaccagataggccaatgcggatggaagcatggcaaaaccaaaggtcatcgccatgactgattgtgtagctccatttaatacgccgcccagtgcggcaagaaaatcatgtatcgtaatcatatgattcatatcctttctcagaaaagattgtggaatgcatcacaaggccctcttagcaccttgtcgcatatcttctctccctcttttgccagttgtctttcatccaccgttacaagcctgccgttttcatatacgacacgtccgtttatcatggtcatatggacattgcctgtcaatccaacccttccgatgatgttgcgcgggtcgtggaccgctcccaccagttccagtgcaccagcatcaatcatgaacaggtctgctgcctttccagcctccagtgaaccgatatcattccttccaagggttttagccccattaatggtcgcctgctttaaaatctcataggccggcacaccgcctccgcgttctttactatgatagcactgcatcatatatgcggtgcggatggaatccaggaggctgcttccgtcatttgtggcagagccatcacagccaaggcttaaaagaacgccatattccttcagcttcttcatcggaaggatagggaaaccaccaagaatggcaggtgatgggcaatgtgagataccgcatccgtattctcccaatattttatattcttcgtccgtcagttcccagcaatgggcaaaccatgtattctcattcatgaatccaatccgtttacaccagtctaccgtgcgcatgccccagcgttgctgcatgttctcattttcaccttcccccagatgtgtatggagccttaccccagtctcccttgccagttccacggaacggataaacgtatcctcataacagttcactggctggcatggcgcaatgacaatctgtctcatggaaaatgcgcctgtatcatgatatgtatcaatcagcctcctggtatcctggatgaattcatctgttgtttcaagcatgtcatccggcatggtgctcccctctgtccgcgggagtgtgttggttccccttcctgcatgataccggattccaatctgtgcggctgcctccatctgacggtcaaccggctccttttttgtgtggaccgtatagcagtattgatgatcaaaagcggttgtacatccgtgttttaccaaatcagccatcgcggtaagtgatgagtaataaatcacatccgaatctatcttctgaaaaatccggtatatatgatccagccattccactactttcatatttggataatcaatggttaccagattcctgacaaaggtctgaaaaaaatgatgatgtgtattgaccaggcctgggtacacgaatttatcggctgcatcgattacctttgcgtcatcacagtggatgccatgtcctatttcaagaattttttctccctgaatcagcatatcggcattttggtaaacatcatccttttcattgcagcatacaatggctgccgcatttttaatcaatatcttatccatattcatcaatatcctccttgcattctgctctgttttttactaatatagactatatagttagtatatagtcaataggaattttgtatttttatgattattttagatgaggaggattcttatatggacttattgacgggagaacttgcaaaaatgtttaatttaaataaacagaccctgttttactatgacaaggaggggcttttgattccggaatacagggatgataagacagggtaccgtaaatacagatttgaacagatttataagctggcgctcatctgttacctccgaaaaatcggtttttcgattgaccagatccgtgagtatatccaggacaggaatgtaaccatgcgcatatgcgaactgaagaggcggtcacaggaacttaggaaagcctatgaggatatactgaacatcgatgatgtaatccagagaaagattgttttcgtggaacataagatgcgcaatatgaaacttggtgaggcggtggaaaagtattacctgaagcgggcctacctcccccttggactggaggaaaacatctatacaaaggaagaattctattttaatcccaccattgcgttctatcggtacagggaagatacggatgggtatgaaacaacctttggcgcgtatttggaaaccatggatgacatcgaccccgttaccgcagacaagatccgctacatcgaagcccagaggttcttatgttactgctggaaaggggattacaaaagcatcgaacagaagataaaagagttaaggcaggaatatgggcacctgggactttccccaaatacttataattttaatatcatcgaccaattccttgaaaaggatatggaacagtatataacagaaatacagattcccatcattgggacaggagtgaatgaacagaatacgtgaaagcaggacaaggcgtccaatctgacaccggtcctgctttccgaatacactgccgcttatgtcctggttacggcctgtatatatatcccatcatctgtcctgcgggtatttatttatccgtatactccttaaacagcttgacaaaggtcccgctcagcagcaggattgcaatcatgttcggaatcacgataaacccaaccgccatgtcggccagcgaccagatggcctcgatgggcatggtcaccgcaatgatcgggggaatgaaaaagaaccactgaaggaccttcacgttcttctccccaaacagatactccacactggtcctgtactccacaaagaaccccaggtaactggaataggtaaaaagcacaattgcaatgcacaggatataggtgccccatctgccccagaccgtcctgaatgcagccagtgtaaggactgcccctgtatcgccgctgttccacacaccgctggataggatggccagtgcagtcagtgtacagatgatgattgtatcaataaatacctccatgaccccgtacatcccctgatgggccggatggtctgtctgggccgttgcatggaccgttgcggcggttccttcaccggcctcattggagaagatacctcttgacgcaccgcgtcccatggcaagggttatggtagatcctgcaaacccgccggctgccggcatgggcgcgaacgcatacttgaaaatcatgccaaaggcttccggtacccttccgatattggcaatgaccaccaccagcgcgcctatgatatatatgacgcacatgggaggaaccaccttgccgcagaagtcaccgattttttccacaccgccgcgcacaatgatgaaaatactcagggccaccaggaggataccgctgacaatcagagggatgccaaatgtatcctgtgcagatgtggcaagggtgttggtctgcacaaagcaggcatccgtgaccaccagtataaaaagcgccaccgcataaaagccgccgaaaaaccgtccggctcccccgcccagcccttctttaatatagtgcatgggaccgccgtaatattccccgttctccccctttttccggtaagccacggaaagggtcacttctgccatcttggtcatcataccgaccagggcaatcacccacatccagaacacggctccaggcccgccgatggcaatggccgctgccacgcctgcaatgttgccgctgccgatggttcctgccagcaccgtggacagtgcctgatatggctttagctgtccttctcccttttcactttcattgtccttcttaaaaacttcccccaaggtctttttccataccgttccaaaaccggtaatctggaaaaagcccgtacgcacggacagatataagcccacgcccaccatcaggatcatcagcggggttccccataaaaattcagtgatgtttaccagtgcatcaaacataccaatacctccactttgttttgactgcggtcagtatccaactgccggccgctccctacaggaactgtattgccgcacattccccctggtgcttctccgtgcggcagttgccgatatggcagttcatacaatcatctgcaaaccacccccgatattcacgtttctctttaagcccactatagcaccgttaatgtaccaagtcaatgagcctgtccttcccactgcatgtgcctgactgcatgtgcgcctattccatttatccttattccatgcgctcccgtccccatatgtgcattcactaatatacataaaagcgttgaagtttaaagtgataaagtattgacatttacaagcagatggcgtacactagagcgtgactgaaacgtgcctttagcagctgcaatatgtatgtaagccgcatttgacacgcaggacataataaggagtacatatcatgattatcataatgaaaccaaatgcttcagacgaagcagtccagaaagtaacacatatcattgaatccaagggcctgcaggtccacctttccaaggggtcccaggtcacaatcgtgggcgtggtgggcgataagaccaggctccagggcagcaacatcgaaatcagcgaaggtgttgacaaggtagtggccgtaaccgagtcctacaaactggtcaacaagaaattccacccggaggattccatcatcccggtcggcaacacccatatcggccctggaaccatgaccgtcatggcaggcccatgcgccatcgaatccaaggaccagcttttggagaccgccttcgcggttaagaaggccggcgccaccttcatccgcggcggcgcctacaagccccgcacctcaccctactccttccagggtctggaggaagaagggcttaagtatatgaaggaggccagggaggccaccggtcttaatgtaatctgtgaggtgaccagcctccatgccatagaagctgcgtccagatatgtggatatgctgcagattggcgcaaggaacatgcagaactttgaacttttaaaagaggcaggcaaatccggtcttccggtattgttaaagcgtgggttaagcgccaccattgacgagtggctcaatgctgccgaatatatcatctccgaagggaatcccaatatcgtgctctgtgagcgcggcatccgcacctatgaaacatccaccaggaataccctggatatcagcgcggttcccgtcatccgccagaagagccatctccccatcatcgtggacccaagccacgccactggtgtaagggcttatgtggagcccctggccaaggcggccattgcggtgggtgcagacggactgatgattgaagtacacccctgcccggccaaggcgctgtccgacgggccacagtccctgaccttccctgcttttgaacagctgatgcaggacttaaagccatacgcagacctggccggccgtacatttgaagcaagatgactgccgcgcgtgtaaaatgtttttccagcactccctcaatcagagagtgcttttctttacaggaggattaaccatggaaaaaataaggatgacagactccaccctgggcttcatcggtctgggactcatcggcggctccattgccaggggcatcaaacgtgcccggccggacataaaaatcatggcatacatgcgttccaggaacaggctggaacaggcaaaaaaagacggcgtggtggatgtgatattggatgggattgatggaaatctaagggagtgcgacctgattttcctctgtacgcccgtggaatataacgcctcctacctctcttccatccgcccgtatctcaagcccggcgcactgattacggacgttggaagcaccaagtgcggcattcacgaagaaatcatccgccagggacttgaggattgtttcgtgggcggccatcccatggccggttcggaaaaaacaggctatgaaaactccacggaccatctcctggaaaatgcctattacatcgtcacgcctcccgaaggcagcgcaccctcttctgccccggaacccagcgccaatgcccggcggatcatcgcagtggcacagaccattggagcaatcccccttgtgcttaactaccgggaacatgacaaggtggttgctgccatcagccatctcccgcaccttgtggcatccagccttgtgaatctggtaaaagacaatgatacggcccagggcaccatgaagcaggtggctgccggcggtttcaaggatatcaccaggattgcttcctcctcccctgagatgtgggagcagatctgcatgaccaatgtgggtccgattgcagatatactggaaaaatacatcgcctcattgaatcagatactggcccaggtcagggggcactgcggggactccatctaccagttgtttgagacatcccgggactaccgcaattccatcacggacagggccaaggggtccgtggaaccgtcctatgaatttaccgtggatgttgccgatgagatcggtgctatttccaccatatcggtcatcctggcagccaaaggcatcagcatcaaaaatatcggcatcaacaataaccgggaacgcggggagggcgcccttaagattgcattttatgacgagtcctccatggaagctgcctggaaacgcctggaccagtacaaatacgaaatgttccgcatgtaatcattgaaaggacaggataatcattatggaattcagaaaatcacatggacttcacggagaaatcacggttccgggggataaatccatctcccaccgggccgtcatgttcggctccattgcaaaaggcaccacggaaatccacaacttccttcagggggcggattgtctctccaccattgcctgtttccagaaaatgggtattgacattgagaataaccgtgaccgcgtcattgtcaggggcaatgggctgcgcggccttaggcggccccaggacgtgctggactgcggcaacagcggcaccaccacccgcctcatatccgggatcctctgtgcccaggaatttgatgtgacactgacaggggacgaatccatccggaaacgtcccatgaagcgcatcatggaaccgctctcccttatgggggctgacatcacaagcatgaacggcaatggatgtgcgcccctgctcatcaagggacgtcccttaaaaggcatccattatacctcaaaggttgcgtccgcccaggtcaaatcagccatcctcctggccggattatacgccggttcccccaccagcgtgacagagccttatgtctccaggaaccattcggaaatcatgctggacctgttcggcgcagacattaaggcttccgggaccacgtgcaccatccagccggccagggagcttcacggcgcccaggtcatggttcccggggacatctcctctgccgcctatttcattgccgcaggacttatggttcccggctcacagctgcttatccggaacgtgggcatcaatcccaccagggacgggatcatccgtgtatgtcaggatatgggcgctgaccttgagctgttgaatgtgtcgtcaggcgccggagagccgactgccgatatcctggtccgcagcagcagcctccacggaacggaaatcaaaggagccatcatccctacccttattgacgaactccccatgattgccgccatggcctgtatggctgagggtgataccgtcatacgggatgccgctgaattaaaggtcaaggaatccaaccgcattgccgtgatggttgaaagccttaaggccatgggcgcccatgtggccgaaacagaggacggcatgatcatacacggcaaaaagccgctccacggcgcttccattgacagcaggaaggaccaccgcatcgccatgacctttgccgtcaccgccctctgcgctgacggtgtcacaaacataaaggacgctgactgcgtgaatatctcttatcccgggttctaccatgacctggaacaattaatgaagtaatcataaaaaacccacaaaaaagctgcggccctccctgcccctttacagggagcatgaaaaacggaccgcagctttttatataccttagcttttcatttaccttagctttttatttaccttagcttttcatttaccttagcatagcttctaccccaatgccacgtctaaaatcatcatgaccacaaatccggcggcaaatccaatggttgccacattggaatggtccccctgggccgactccggaatcagctcctccaccaccacataaatcatggctcctgccgcaaaggacaggaaatacggcaatgccggtcccagtacttccgaaagggccagcatgaggaatgcgcccaacggctccactatgccggacagcatgccgtacacaaaagccttgggctttcccacggcctccttaagcggcagggaaatgatagccccttcaggaaaattctgtatggcaatacccacggataatgccagggcgcctgccatggtgatggtgctgttctgggacataagccctgcaaaggcaacccccaccgccattccttccggaatattgtgaagggtcaccgccagcaccagcatggtgcttttcttccagctgcccttggggccttccggttcatccgaatccatatggagatggggaatcacctcatccaggaccagcagaaagccgattcctaacaaaaatcctatggatgccggtacaaatgccagcttccccatgtcctggctcatattcatggacggaatcagtagggaccacacggatgcagccaccatgaccccggatgcaaagcccaggaatgctttctggaccctgggccgtaaggcatttttcaggaaaaagacacaggccgctccggctgtggtccctatgaaaggaatcatgattcctgcaaaaatattcatgttcatacctctgtcctaatgcttggcactgcgctgtccctacaggaaaccgcgcagcttcagatagtccttaatcagctggatcatctggtcatagtcaatacggctggcattgatgggcaggtcgtaattctccatatccatccattccctgcctgtaaagtagcggtggtactccgtccgctccttgtcaatccgtttcatgcggcgcagtgcttccgcctcatccaccttatccacatccatgaccctgcggatccttgtaaccgtgtccgcatatacaaagatgcgtatcaggttatccatctgatcctgcagcacatagttgccgcaccgcccgacaatgatgcagggttccgatgcagccaggccgcggatgacggatgactggaaacggaacaggttttccggggatgtgatattatgcccatccctctccggctctgtcagctccggcttcatgccggtcacaatgcggtacagcaggttattgcccgccttctcgtctgccagccggaaatactgctccccgatggcgcttgtctccgatgtcatcttaagtatctcttcatcataaaaatgtatgcccagttcctctgccagccgcttgcctgtcagccgtccgccgcttccgtactggcgttcaatggttattacaaaatgtttgtcactcatcatcatgcccccttatcctattatatcaatatggcacattttcatggcatttaacgcgttctcatggctttgcggggttacccctgcgcagcaggatgcatccacctggatgggtgtgtccggtatcactgccttaatcagcatggcattggagattacgcagatgtccgtacaaaggcctactaactccacactttcataccgtccaagggccgcataatcagccagttcacggctgccaaaggtagccttctcaaaccgttttccctcaaactccttaagcccttcaaccagttcccagcccggagtccccttgacacaatggatgaccggaagcttcttaccttccattgtatccatgtaatcctcagaatgcgtatccagtgtaaacacgacttcctggcccgcttttccgtaagccttaatcttgtcaatcacatgagggacaatggcctgggcttccttactccccagggatccgtccacaaaatccttctgcatatccactactacaagtaaacggctcatgtaactatcctccttgttattagcaccggcgcttcccagtgccaatgcctctcaggttccggcagcatccttgcggacattgcctttcctgtcatttacagtctatcacattttgacaatcaattaaagatattttcacaaaatttaaaaaccctattgacaaattgaatccgttgtattaagatacgggttaataaatcaaaccgtagagaaagaggagtaagcttccaaagcattaacacagagagccgcaggtggtgggattgcggtataaggctggcagctgaatggacttttgagggcggtcctgaaagatagttccgtagggaccgacggattccgcaaccgttattcatgcggcacatatgttggtatgtgtaaagtggacttttcagtcaatttgagtggcaccgcggatttttattcgtctcaattatggtataaccgtaattgggacgtttttttgtccccttgccggacctgtttaagatgtacggccataaaccagccatgggtcagattgacggccgggacctgcaggcagcgcgcagcctgtaacccggacagcaacggtcctttcccaacgcagttcattacttaccatagaaaacagatcatggaatcaaaacaatcattcaggaggattttaattatgaaaaaaacaatcgcaatgcttttagccgcagccgtaagcgcatccctgttagcaggatgcggttcatcttcacaggaccagaccaccgcacaggtatcttccgaggcagccgccaaggataccacaggaaaccaggagacttccgccggaacggcttctgataaggagacggcagggagccaggcagacggggagggttcctataccatcggcattggacagtttgcggaacacggttcccttgacaactgccgcgagggcttcctggaaggccttgccgaggccggaatcgaggaaggcaagaacctgaccgtcctctatgagaactcccaggccgacggcgggaccgccagccagattgccaccaacttcgcaggcagggacgtggacctgatgtgcggtatcgcaacccccatggcccaggcagaatacggtgttgccaagaaatccggcaccccggtcatctttacggccgtcacagacccggttgcagccgaactggctgatgccagcgggaccccggtaggcgagattacgggaaccagcgacaaactgccggttgagcagcagttaaagatgatccgtgaaatccttccggacgcaaagcgtatcggcatcatgtacaccaccagcgaggtaaactctgaatcagccattgcggaatacaaggagcttgcgcctgactacgggtttgagattgtagacaccggaatctcctcctccgccgacatttccctggcagcagataccttaatcagcaaggtggactgcatcaccaacctgactgacaataccgtggtcgcctcccttcctgtcatcctggataaggcggaagcgaaaaaaatcccggtattcggaagtgaaatcgaacaggtcaaaatcggctgtctggcagccatgggcctggactatatcgaacttggaaaacagaccggccatatggctgcacaggtattgaagggcgagaagaaagccagcgaaatgaattacgaaaccatcaaggaagctgctttctacggcaacaccaaggtggctgaaaatcttgggatcacactgccggaaagccttactgccgatgcggcggggatttttactgagattgcacagtaagaagggttcatactgatttgggaggaacatcatgacaacgattattttcggtatctttgaagaaggcctggtttatgccatcatggcccttggcgtatatatcacctataaaatcctggattttccagatctttccgtggacgggacatttcccctgggcgctgcccttaccgccatcggcatttccaacggcctgcccatcatcgggaccatccatccggtcctggccctcatcctctcctttggtgcaggtgccctggccggatgcgtcactggcctgattcatgtaaagctcaaggtacgcgacctgctgtcaggaatcattgtcatgaccgccctttactccatcaacctgaggattgcaggaaagtccaaccttcccatcttcagcaaggacacgattttcagcaatccattcctcacggaaaccatccccaatgcgctttccccttatgtggtgaccattatcctgtttgtgatcgtgctggcctgcaagctgcttctggatgcctatcttaagacgcgttccggctacctgctgcgagcagtgggtgataacgacgtgcttgtcacttccctggccaaggacaagggaatggtgaaaatcgtgggccttgccattgccaatggcttcgcggccctggcaggcagtgtgtactgccagcagaaaggatttttcgatatctccatcggaaccgggaccattgtcatcgggctggccaatgtaatcatcgggacccagctgtttaaacgctttggttttgtcaaatccaccactgcagtcatcatcggttccatcatatacaaggcctgtgtatccctggccctgctgctgaacgacatccctgtcaatcttggtttcctccgttttaccatatccgtcactgcctcggatttaaagctgattacagctatcctgttcctcatcatcctggtcttaagctcctccaggggaaagaaggtaaagagccatgcttgaactgaaacacatcaataaatactacaatgccggcacaatcaatgaaatgtgcctgtttgaggatttctgccttaccatcaaggaccatcagtttgtctccgtggtgggcagcaacggttccggcaagacttccatgctcaatatcatctgcggcagcatccccctggacgagggccatatcatcatcggtaatgaggacatcactaagatgccggaatacaagcggcagcgccgtatcgggcgggtatatcagaacccggccatgggcacctgcccatccatgacaatcctggaaaatatgtccctggccgataacaaaggcaggtcattcaacctccgcccgggcaccaaccggcagcgggtggaatactaccgcgaatccctccgctcccttggccttggcctggaggataaaatggatgtaaaggtcggggtgctctccggcggccagcgccaggccatggcgctcctcatgtccaccatgacccccatcgagttccttatcctggacgaacacacggctgccctggaccccaagacagcggaaaccatcatggaactgacggataagattgtcaaggaaaaggaactgaccaccatcatggtcacccataacctgcgctacgccgtggaatacggtgaccgcctgctcatgatgcaccagggacgcgccatcatagacaaggaaggcagggaaaaacaggagatgcagattgatgatatcctggaacgttttaatgagataagtattgagtgcggaaattaaggctgatggtaacagactgatggtaacatactgatggtaacatactgatggtaacagcctgatagtatcaggttaactggaatgggctgtttataacagccgggccggaatatgcatacgcaatgaaaacgggcgttgtcctgaagggtaccagatggattccctcagggcaacgcccgtttttcttcattctcttattactcagcaaacaccatgattttcactgccgagttctcatcatctgcccagaccacgcacttcctgccctgggttaaatcgtcaagggtaacgatattccttgtaaggtatgggaatatgttgcagtcgtctgcaagtgtgtactctgttccgtcaatggctgtaagcactgatttggatgtggatgcgtctgttatcatggacttgacttccacataatccggaacctttgcatcagccggtatgttggcgaatatcacggttgcgttggtcattggcggaaggctcatggtcatggccggccctatgtaggcgtagatggtatcgccgtccttgatgtcctccagcttgataggaaggccgctgaccgcatccagtatgtaagtctcatctgcaacgttaaggatgatctcaccgctgctgcttacgcctgactgattgtcaatggaaagcctgccgtcctctgtcctggtcactggtccgaatatacggatggcctggggcgcttcgggctcgctctcttccatgctctcaatggctcctgtcactgactccacaacggtgtctgccaccgttgtctcttcctttgtggcttctttactctcctgtgttgctgtggtagtgcctgcgtttgcattggaagcacaccctcctacgccaagtaccactgctgcacagattcctgctgcatataatcgatattttctcaatattatcttctccttttcataagtaatgccctgctttagggcattattgatgtctgtatgagaagtatatatcatttcctccctatatccaataaaggatttcttaataattctgaaataaggattaacgttatgacgattgttgcaaattttttacaaaagaaggaaccctatcttaagatatcacggaaagccccttaatccttatcgcgccatctccagctgcggtcccttctggttatgggctttgatgatggtttctatctcgtccaggttggaggagggaaggtcgccggggatggtattcttaactgcagcggttgcattgccgtaggcaatggccttttggcagtcgccgccgctgctgagcagtccgtacagggcgccggaaatataggcgtccccgcttccgatgcggtcaaccacctcgatgtcgcggtaaggctcctcctcgtaatattcattcctggcagcatcgtaaatcacggaaccgaatgtgtggcgcttggggctgtggacaatcctctgggtggaggccacgatggaaatggggaactcttccgtaaagctcttcatcatttcccgggcagtgcctgtttttaggaatgtaagccgcgccgtgtcctctgaacagaagaagatgtccacatagggcaggatgcgcaggatacattccctggcctcgtccccggtccacagattgccgcggaagttcacatcaaaggacaccagggttccggctgccttgaaacgcttaatcatctcgatggtagtctcacgtatatccccgttcagggccagggtaattccggttgtatggaagcacttggatgccgtgtaaacttcctccgggatttcattaatgtccagggagaaaaaggaactgttgttgcggtcataaatcacctttggttttctggggtatgcgccgttctcataatagtaaattcccacacgggcagatgaggactggtcatacatgaagaaatcatcgctgaccccgaaggaacggatcttacctttcatgaagcttcctatatcatgggccggaagcttggaaatgacgcctgtgtggagtcctaacagggccgcacccacggccacgttcagttctgccccgcctacctgcttcacaaatgtatcccctctggacagacgctcattatcaggcggtgaaagcctgagcaatacctgacccagggtcagaagatcaaaattcctgctgttattcattcccatcataactctcctttttctttatataagaaacggctaattcccatagaggattagccgcttccaaattgtctggtgattacatataaaagtgattatctctgaacacgtcctgaaccgtcgccgccagccaggttatctacgtcagcgcgtgtaaccaggttgaagtcgccagggatggtgtgctttaatgcagatgctgctactgcgaattccagggcagccttcatgtccttgccgtctgccagaccgcagattaagccgcctgcaaaggagtcgcccccgccaacacggtcaacgattggggtaacacggtactttttggagtgatagaactcacgtgtcttaccgtccatgatgcatgcggaccagccgttatcggatgcgctgaagctctcacgcagggagctgatgatgtacttaaatccaaacttatcagccatctggttgaagatgtcaacgtatccagccagttccagttccccggaggtaacgtccgtgttgcctggcttaaagcccaggaccttctcagcgtcctcttcgttgccgatgcacacgtcaacatactgcatcaggttagtcatgaccttctgtgccttctcggaagaccacagtttcttacggaagttcaggtcaacggatacggttacgccgtgagccttggctgcctttaaggctgcctctgtcagttcgattgcagcatcgctgacagctggtgtgataccggtaaagtggaaccagtcagcatcagcaaaaatctcatcaaagttaaactcgtccggggtagctgttgcaatggcgctgtttgcacggtcataaacaacattggaagccctcatggcagagcctgtctctaagaaatagattcccagtctctcgccgcttcttgcgatgtgcttggttcctacattgtatttcctcagggctgctactgcgcagtcaccgattgggttcttcgggatagctgtcacgaactgaacgtcatgtccgtagtttgcaagggatactgccacgttggcctctccgccgccgtaattgatatcgaactcgtctgcctggatgaatttctcattgttcggggtagataatcttaacatgatttcgcccatggtaactatttttgccattgtatgattctccttttatttacctgattatgattcaaattgaatgggttggttattttgcccttgctgctgccacggcctgtacgaattcctgggccttagctgtaactgctgcgaaatcgccggtcttagcgcccttggtcaggctggagccggttccaactgcatatgcgcctgccttgatccacttgtccacattgtcaacgtcaacgccgccggatggcatgaactcgccctgtggaagaggtcctttgaaggagctgatggctgccggtcccacaatattgccagggaataccttgatgatatcgcatccggcttccagtgcggtgattgcctcggttggggtcatgacgcccgggagcatgggaaccctgtagcggttgcacagcttgatggtgtccacattcaggccagggcttacgatatagttggcgccggccaggatgcatgcccttgctgtctcaggatccaatacggtacctgcgccgattacaatcttgtcgttatctttatacttattagccatcatcttgatgaactcaacagggtcgccttcatccatggtcatggtcagctcaatgaagttgatgccgccctcgatgatggcgtcaactaccttctcaccctgctcgtaattctttgcacggacaaccgcaaccagacagtcctctttcattcttgataaaacttgttcttttttcatttcgcttctccttctttccgcaaattcgcatatacgaatcaatttcatatttgcgattttatacttaaattttaatcgctaccgcttgatttgtcaacagcaaaagatgtaaaaatataagtttttctactgccttttcagcattttcccaaaaagcccagcagccttgatatctctgccgccttggtccgcaccaggcagcccagcgcatcgtaatcttccgtgggtttgtaaaggctggatacgctgatggcgcccatgacattgccgtcctggccaaataccggcgatcccacacattccatgtgttcctccagctcccttgcgtcaaaagcatagcccttgtcacgaacacgctccagttccttctccagttcctccctggtaactatggtccgctccgtatgcttcttaaatgtaatgcgctccatcagctgccctgtctcctcctcatccgagtaagccaggatggcctttcccagggaagtgcagtaaatcggattcttggtgcccacagtggctgtggtgatgatggggttctccggctcaaatttgcagatgtagacaatggcatcgtcggagcggatgccaaagaatacggtctttcccacctcccttgaaaatgccttcagcaccgggtcaatggtactgatgaaatccaggttattggtatagttgatgccgatcctgtatgccgtaagaccgatggtataacgctgcttctgccctctggccacatgaatcatcccggtctgtaccagtgttgtcacgatgtcgtagccgcttgtcttgggcaggtccagcttctcgcatatctcgtccagcgtaatcccgtccggcttcttggacaccagtttcagtatgtctatggtccgcagtgtggttctgtttaatttcatggatacctcccaccttctgtcacatgtatgtcacccgtatatgcaaatggatttggatatgcagatattgtattctgtattcgtatatgcatatcaaatccgtatatacgatatcatagattcagtatacatcatcttcctctgtgatgcaaggggtaattccgccataaacaactgtttttccggctattttatccaacggtccggcggctgtgcctgtgatgacggtatccggctatcaggttaactactgccgccggacttaattcctgccgccgggcttaattgctgccaccggacttaattcctgccgccgggcttaattgctgccgccggacttaattcctgccgccgggcttaattgctgccaccggacttaactactgccgccgggcttcctacagtgtaactccctgcttgaagattgccatatcatggaagccagcttcttctgacttcactttcctgccggaagcaactgcaagcacataatccaacagttcttctgccagttcttccttggtcatatcctccaccatgcgtcccgcattgaaatcaatccagttatccttgtgtcctgccagctttgaattgctggaaatcttcactgtaggcacaggggatgcaaagggcgttccccttcctgtggtgaacaggaccatatgggcgccggacagggccagggcagtggatgccaccaggtcgttgcccggggcgcttaaaaggttcagtccctttaccttgaccatctccgtgtattccaggacgcctcttaccagggcgctgcctgacttctgggtacagcccagggacttgtcctccagggtggagatgccgcccttcttattgcctggcgaggggttctcatagatggtctggttgtggctggtaaaataatccttgaacccgttaatcaggttcacggtcttttcaaacagttcaggcgtggcgcagcggttcatgagcagtgtctccgccccgaacatttccggcacctctgtcaggatggtggttccgcccttgcttaccagaaggtctgagaatgcgcctaccaccgggttggccgttatgccggaaagtccgtcagagccgccgcacttcattccaatcacaagctcgctggcatcaatcttctccctggtaaatgcccctgcatacactgccagttcctttaacaggtccatggccgcctccatctcatcctccacatcctggcactggaggaatttcacacggtccttgtcataatccccgatgtaatccatcagcacgggaatattgctgttctcacagcccagtccgagtaccagcacgccgcctgcgttggggtgatggatcatgtcggccagcaccttcctggtgttttcctggtcatcccccatctgggaacatccatatggatggggaaatgcaatcacatcctccacactgccctttaccagttccctggcccgggcctcaagcgccttggcaatggaattcacacatcctaccgtgggaatgatccagatttcgttacggatgcccgccttgccgtcagacctgcggtaaccgtcaaagtaaacgtgctccgttggctggacatccgttccgtccggcgtataatcataggtaaggacatctcccagggctgtcctcacattatggacatggacccatcctccttccttaatatcttcctttgcatatccgatacggaaaccatacttaatgacttctgcaccgcttccaatgtccttcagggcaaacttatgtccctgtgggatatcttcctgaatggctaccttcctgccctccacgtcaagtgtctcgccctttgaaacaggccgcagcgcaacggcgacattatcgttcctgttaatcttaacaatatcctgcatggtctttacattctcctatcattgttatttggtgtgcccgctttattgtaagtacttacaattattctactcattttcaaggaataagtcaataaaaaaatagaaaagtattgcaatatttacgcggaatatgtataatgaacttagcttgtaagcgcttacagaatgtgaggttattttatgaatatatacgatgtctctgaacatgcaggggtatccattgcaactgtttccagggtactgaacggcaatcccaacgtcagtgaaaagaccagggaaaaggtccttaaggtcatggatgacctgggatataccccgaatgtatttgccaggggactggggcttaataccatgcagaccatcggaatcatgtgttccgattcctccgacccctatctggcgggtgccatctactatttggaacgcggactcaggtcccataattatgatgcaatcctgtgctgcacgggatatgacctggatgcaaagcagaagtattttgagctgctgcgctccaaacgtgtggatgccatcatcctggccggctccaagtttgtggagatgcggcccaaggataatgcatatattacggaagctgcttcagaacttcccatcatgctggttaacggatacctggaaggggataatatctacagtacggtatgcgatgaccatgctgccatgtacggcgccgcttcccagctccttaaggccggcaggaggcgtatcctgtatctgtacaccagctattcctacagcggggtcaacaagctggagggctacaaggatgccctgaaagcttacggaatggccccctgcgatgaactgatccggcagtgtcccaaggacatatctgctgccaaggaactgcttgtgtcccttcatggacagggactggaatttgacgcggtcatgacaagcgatgattccctggccgtgggtactgttaagtatgcccacgcatccggcatttccatacccgatgaactgaatatcatcggatacaacaactccatcctgtcccagtgcacggatccggagataacatccattgacagcaaggtagaagcactgtgcaccaccaccatcaacacacttatgggggttttcagcggcgtgaatgtgcccagcaggaccacgatcgcctctgatttaataaaaagaaaaaccactaatttttaattcttaaggaggattaacaacatgaaagcatttatggacaaggacttcttattatccagtgatatggcaaaggagctgtatcatgatttcgcagagaacatgccgattcttgactatcactgccacatcaatccgcaggagatttacgaagaccgcaagtttgataatatcacccaggtatggctgggcggcgaccattacaagtggcgccagatgcgctccaacggcatagacgaaacgtacgtgaccggagacagcacggactgggagaagttcaaagcatgggcagagaccatgcccaagttaatcggcaacccgctgtaccactggagccatctggaactgaggaagtattttggttaccagggcttcttaaacggagatacggctgaggaagtatggaacctctgcaacgcaaagctgcaggaggattccatgacagtccgcaacctgatcaagcagtccaatgtcacccttatctgcaccaccgatgacccggttgacacactggagtggcacaagaagattgccgaggatgacacatttgacgtacaggtccttcctgcctggagaccggacaaggccatgaacgtcgagaagccaacctttgcagcttacatggcgcagctctcccaggtcagcggtgttaaggtaactgattttgcctccttaaaggaagcccttaagaaccgtatggcattcttcacctccatgggatgctgtgtatctgaccacgcacttgaatatgtaatgtacgttcccgcggatgaggctgaaattgacgccatccttgccaaggggttaaagggagaggccattaccaaggaagaagaactgaagttcaagaccgcattcatgctctttgttgcccgtgaatacactaggatgggctggatcatgcagatccattacggctgcaagcgcgacaacaacgcctacatgtttgagcagattggcgctgataccggttttgactgcatcaacaattacgcccccagcgcacagatggctgactttttaaatgcactgagcgcttccaacgagataccaaagaccatcctctactcactgaaccccaatgacaatgcctccatcggcaccatcatcggctgcttccaggacaagttcccgggcaagatccagcagggttctgcatggtggttcaatgaccacaaggtgggaatgactgagcagatgaccagccttgcaaacctgggctgcctgggcaacttcatcggtatgctcacagactccagaagcttcctgtcctacaccagacacgaatacttccgccgcatcctgtgcgaactcatcggcggctgggtagaaaacggggagtatcccgcagacatgaaagccttagaggacatcatcaaaggcatctgctataacaattccgtaaaatacttcggtttcaacctggatgttgtaaaataggattacttatatgataaacttggtcatatagtaaaatcaggctggcgtccgccgggcgaattcccagcggattggatacacaggtacgaaggacgcagaaagccccctcaaatcaacagatgactgagggggctattcttaattccaaattctacaaataaatatcatactttcaatccacagaataatccagccttatttcagccgcaccacatgctggcagtaaatatacagattctttatcttcttggcctgctgcccatcatctcccaacacaataggctgtgttcctgaaggtgttatgtacagtttaaacgcaagcgcatcctgaccaacatgcatatcttttaccggtgcgtatgcgaaatcctgtcgttcaatatccagatattcaaacatgatatgttccaattcagggtttgaaaagacgcgtacaatatccgccgctcccttcatctccatgatggcttttgcttcttcaaatgcaatattagtgaaacggtagtcgccattccccaaaatataagccagcatactattatccaataacaataacggatctttcgccataacaatacctcctttttattaatacacttcgtttcactattatcataagccattatacaaatattgtcaatattgttagaaaacaatcaatatcgttcgatatttatcaaacaaattccacaaagtgattaaaattaccttgacatatcaaaagagtttttcaacaattcacaatttatcagaggtccattttctctatgcggattctatatcttcccaattgagccagtacatgattgtcttccgctttcattttcggactcctttcccatatcaggtcctgatagcggtatatgctaagcaggattccgagcagtccatagacagcaaccgtgtgatatcccccatatgtaaaaaagggaagcccggccgtggacacaaagacgaatccaaggttcagcatcaggttccagcctgtttccaggacaaggatcatgacacatccataaccaatcagctgcccaagctgattcttctgctttttcaccatgtggaacagcaggaacaaaaacaggattaacaatccggccaggatccctactgccaggactccccaggtggaggctgcctgcagcatcacataatcatattgtgcaccaggaagcaaatggattggggttccctccggcgtaccgccctttgtaagcccgcccaggaatttaagctgcttcatgatatcccttgtcaccactacctggaatgcctcttccctggcataggcccatggactcaggattgcccttaaccttgccatctgatatggctgcattccaaggtaggaataacatccgcccgccaaggccaatgcccccagcccaagaatcggcctgcttttccgtttcacctgataccagttcctgaacagggaatacatcagcatcatgaagcacacagacatcacatccagtgtaatgccaatcccgccgccaatcactgcaaatgaagtataggcagcagccagcagccataaaagggaacggatgacacctgaataaccggtaccgcgatacccatagagaatccctccatacatgggaatgaacagatacatgaccgtcttcatatagctgtgtcctccattgatgacctggaccatccccagattgcagacgaggatgattgaaaccaggaacagccctccaatcagtttcccatatctgctaaacagactgtaatcacaaaagtaaaggattgacatgaatcccaatcccaagaaagtgtaaaggcattggcgggcaaatgcatcctggtttatccggtacaggttttctgtaccaaaccggtaaatacagaaatactgtaccaacagcccggccagacttaagagcattgccattcccaaaaccatccagttgtttttgggcctgtggatacggtccatatcaatccctacttccacggggcttcccatctggcggaccgcttcttccagcgcctcatccctggtccgccccatctgctcataaacctgggcctggtcttcgatatgagtccggatttccctctcaacctcctgctttgcctttttattacggatctgcccggttaattcagacaaatattcatgcatttccatataaggcacctcctatcacctgtcccactgcctttgtataggtttcccatgcctcctttttccttatcagttccgccatgccctgctttgtgatggaataatatctgcgcaccttgccctgggcttccttttcataggatatgagtagtttcctagactccatggtgtggagcagcggatacatggtgcccgctttcaggctaaatacatattcggagcgtttttccagctcttctatcatttcatagccatacatgtctttttcggataaaagctgtaaaaggagcatggatgtattgcctgatgatacaatcttctcttctgccataattgattcctcctgttgacgcgtgtattgttttcatggatagttttggatgggtttgggtatctttatatggatgatggatatatagataatctatatatcatgatatgatttatctatggacatcctttatgccactacatgattatcatatagccattccatataccatggcacgttcattatatagccgttctacctatcataattatatatagataatctatatatgtcaaacactgattttccctttcttcctgttcatctgcagcacggccgtcaccgcgccgctgacagcaaggagcgcataaaagctgattccgcggctcagcatcatcaccgggaaaacctgtcccccgccaagtatgggcctgtatagcgagataaaacttccctctgaggcgccaaccgaccccggaagcggaaccgcggtcacagcaaggctcaggatagcctgcatggcaaggaaccgaccaggttccgcctctattccaagggccaggcaggcaaagtaaggtaccaggaacagggctgtcagctgaatcagcgcgcgaaggaacatcctgacaaccaccagcgggtactgtctcagatacgcccctcccctgctgtattcgttaatcagtccctccattttgcgctgggcctttttgcggttccttatgagctttaccctggttaatatacggatggcccacagtaccacccgctctgccagaaggctgtttaaaataatcagcaggatcaggccggagcagattccattgaccaggatgccgaataccagaagccactgtatgagtcttccctgggacatgacaaaggacaggttaaggagtaccatgacgcttccatacaccagcaccgtcatctgatacacggccgccacagccaaaagtgtaaaggaactgtgggcaaatccgaacccgtccctggtcatgtaaaacagctgcatgggctgtccgcctgtggcagaaggcgtgatggcgctgaaataaaagcccgcaaaggaataggacagggagcgtctgtagggaatctttttatggaaggtcctcataagcagccggatattggcggcttcacagttgatgaacacgaacatgcagaaaaatgcaggcagcacgaacctaagttccgcccgctgaaaggtttcccccatggtttccatggaatggttctgaaaaagcacgtgaaatgtcaccagggccaggactgcaaccatacaaagccctatgagcatttccttcattttcattttcttctgctccatcctgcgccaccttccttcttttcctctgtaattcccaaatcctgtccagacatccatccccgctatctgcacgggcggcaccctgtgttaacgcgcctatgtatggagcctggtgttaatatgccagtgtatggcaccggtgttaatatgccagtatatggcccacgccatccggaccggacaataccatcctggatctgctgtgtatattatactggctatttattaaaacttacggtaattttccttaagaaacacagccaaaccatataaaaaagcctaagactcattatcttagacttttttcatggatgctgttgtatgtgagcaggacggtaagccgggttatgtcgttggatggccatctatctaggactgccgtcgccggcagcctcaagcaacctacccggaagctgacgggccgccatatgcttcctgttcggtcttgcttcggatggggtttacatgtgccccgcctgttaccaggcgggcggtagtctcttacactgcccttccacccttacctttcccggtcaggccgggaaaggcggtacatttctgttgcactgtccctggagtcgcctccgccagacgttatctggcaccctgccctgtgaagcccggactttcctctcctgcggccttgcggtatcgcagcagcggccatctgtcctactcacaacctacacagtttatcatagaaaccctggtttgtccagtcattttccaagccgctgcccacaatgcctcagcctggaaaccgctgcccggccctggttaaacgttgaggcagctgccgccgatgaactcccgcaggattgagttcttcggtatgtcctcgctgctgacaccgatgaaataatccaggaacttgagaagccgttttgcttccagatattcctccgaatccttgggaatgccaaacagcagtggctccgcatattgcttcagcacggcgaactcgtagaccagggccgagttgaacatggcgtccgcctcctcctggaatgggaagatgttctcctcctcgcccttgcgcacggacggccacatacggatggtgtcctgggccgatgaccccctggtcctggcatcccgtatcatccttcggataagacgtccgtctgttgtgggaatccggttgtgctcatctacgttcagctgggttaaggcgctgatgtatatcttgaacttactctcctttggcagggagtgggacagcctgtcattcaggcagtggatgccttcaatcaccaggatgtcctcctgccccagctgcaggaaactgcccttatactccctgacgcctttcttgaaattatagtagggcatttccacccgtttcccatccagaaggtccatcatgttctggttaaacaggtcgatgtccaggcattccagcacctcataattataattgccatgttcatcccttgggctgttcacccggtccacaaagtaattgtccaccgcaatcggatggggcttaagcccgattgcctccagctgcacggaaagcctgtgggaaaatgtggtcttgcccgaggaggacggccctgcaatcatgacgaacttggcgttccgcctggatgcaatctgcgccgctatctctgcaatcttcttttcctgcagcgcttcctgaaccagtatcagatgggacatctccccctttgaaatcttatcattcagggcgcccactgtttccaggtccagcctcctcccccattgggtggactctgtcagggttgcaaacagcttgtccatgggttcaaacctgggcaccactttcggctctgacttggaaggcagaagcagcacgaatccatagtggtaaggaaccaggtcaaagtaccggatatatcccgtattctggaccatatatccgtaatagtagtcctcgaagccgtcaatgctgtagatattgaccctggataccctgcggtaccggaacagccgctccttatcatacatcctgtggcggtggaacagctcaaccgcatcatccgttgacacgctgcgtttcatgatggggatctgctgcgccacatactccgccatcttgttcttcacccggatgagaaggtcattgtccagcacaaagttacccctggcctccacaaagaatccccttccaagtgaaaaatcaatgactatcttctctatattctccgcgcctgcaaccgcataaaatgccttcagcatgatcaggcaggcgcttctctgatacgtggccaaaccaggcttgtccctggcagtgatgaaggtaagctcacagtcttttacatgcttgtgaagctcctggagctttccgttcacacggaccagaaggatgtcatcctcgtactggtactgatattcctcagccacttccagccaggttgtcccctccggatattcccggacaaaaccgtttacattaacttgaaccaaaggcttttacctcctctttcttattcaggcagtcccattcctgtttgttaattgtcctataggatgaccgtgggccatgatggcggcgcctggattacttttacgccctcccccagcctggcggccagatagtcagccatgtagggaatgaagatatgttccagtccgtaatgtcctgcatcgattaccgccatattccttgcagcggcatcaatgccctggtgatggctgatatcacctgtgaccagcacctgggaaccggaggcaattgccccttcaatctcgctgcccccggcgcccggacacacggaaaccttgtttatctccgtatccagcagttcctgtccatagaccactgcaaagggaaggccaaaggactccttgacctgccgtgccagactccgtaccgtcaccggcttcctgagatacccggtcttgccgattccgtaaggcaccaggccctggctcccttccatctcgcccattgcttccagtggcacgcattccgtaaggcccaggcgtcctgcggccaggtcggccatacagccgggggccgcatcaaaattggtgtgcatggcatagtaggaaatatcagcctgaatcagctttaccagccttctggtaatgaaattctggtcatttaccttcttgattgccttaaaaatcaggggatgatgggtcagcagcatatccgcgcccgactctatggctgattccaccacctggtccgtggcatccagggcaatatagattttcctgacctctttatcgctccttccggccagaagcccgggattgtcccattcacacgcacatccctctggcgccagactgcttaacatctcaatgatctcactgcatttcatcctgtgcctcctttatccatcccaattcttccataagggcattcctggcccttaactgtgcctctgtcatggggattgctgtccgtgccggggccatttcctgaacctggtccatcccttcatccccctgcgccttaaaatgatccaggattccctggaccctggcccgttccttctccagatattccttcagtacgccgtccttcctgtccagaaggattttcccataccggtaccatatgggacgcgagtaggtcatggagccgcggcccacatccatgatggtataatatttcccctcatcttttaccatggcttcctcttcaatgacaaagccattctcttccaggaacagcctgaccttgtgtatatcagactgtggggaaaggatccagtggctgacgctgtcccacatgtggcgtccttcctccaggatgcggatttccagttcccctcccattccggcgatgatgaccgtgtccgcttcgcctggttttaattccttaagaccatcgctcagacgggcttcgatggtgcagaaggacggctgcccgccggctgctgcatttttagcggcccacccttcatattcctttatgtgttccctggcccgctcaagaggccccggcctcacatccattgcaatggccctggctgcccggcctgtctgggccagatggatgggcacatatccatgatccgtaccgatatccgcaatgcggctgcccggccttacaaagtcagccactgcctttaaacgcagggacagacgcaccacgccttttaagccgctgccgcccatccctgtcatatccatcttatcatttgtttcctgtttcatattattcatccagataatcctttagttttttacttctgctgggatggcgcagcttgcgcagggcttttgcctcaatctggcgtatgcgttccctggtcacattaaattgccttcccacttcctccagcgtccttggacggccgtcatccaggccgaacctgagttttaacaccttctgctcccgttccgtcagggtcagcagcacttccatcagctgttcatggagaagggtaaatgccgcggcgtcctggggtaccatcacattatcatcctggatgaaatcccccagatggctgtcctcctcctcgccgatgggtgtctccagggataccggctcctgggccattttcatgatttctgacacccgctccacgggaaggtccgccctagcagcaatctcctccgtggtaggctcccgccccagttcctggagaagctggcgggaggtgcgcaccagacggttgatggtttccaccatgtggacgggaatgcggatggtccttgcctggtctgcaattgcccttgtgatggcctggcgtatccaccaggtggcataggtgctgaacttatagcccttggtgtagtcaaacttttcaacggccttaatcaatcccaggttcccctcctgtatcaggtctaagaactgcatgccccgccccacatatcgcttggcaatgctgaccaccaggcgcaggttggattctgccagacgttttcttgcatcctcgctgcccagctccatgctcttggccagttcaatctcctcctccatggacagcaggggaatcttgccgatttccttcaggtacatgcgcaccgggtcttccaggctgacgccctcagggacagaaaggtccagatgctccacatctatctcttcctcttcttccaggctgatttcctcttcaatgaacaggtccgggtccagctcctgggctgaatccatccggatgatatccaccttgctctgttccaggaaatcaaaaagctggtccatctggtcactggtgggctgctccgagccaaagtagcttataatctcctgatattccaggacatttttcttcttctttgcctcctcaagcagtcctgccagtttttcctcaaacacattcgtcccttccataaccggtccatccttcctatgaaatgctgttaatccagtgagatccgcagcttcttaagtgcagcctgctgctttatgatttcctgtaactgggttatatcttttgcattgcggctggccgcatccaggctgttcttcctgaccttcatgacggtttcggagaatgccttcttctgttcttcattgtttaaggactctttgaggcttgcgttgaatagtgccgccacttccttgtactggtcttcatcattgatgaagtggctgagtatggctgccggatttaagttacccgatgcctggccttcaaataccatctgtgccacctggtgatacagatcctccacaaaatcatctgctgtaatgatacccttaatcttgtcaaataactcaggattttctatcagccatgtgagaagaagccgctgggaacggcggatgccatcctccttgtccggctttttggggcgtttgggacgcgcctccccaccatcctgatacccgcttctgccttccggccctgcttccccgtaatcgtaatatccctccgggggcccgtcatagccttcatagtacccgtaatcaggatacatgtcctcttccacggccctgtgctgtaccttgcccccatggtccaggctgtcaccggacttcatcccaaagctcatacccatacggttcaccagaccccgcagctcatccgcaggaatcatctgctccctggcaaccgcctggaggtaattctcccgctccagggcctccccgaactgaaggagctttttggctgtttcctggtagaacctggtcttctgctccgggtcatccatctggtagccctgtctcagcacgtccacctcgaacaggaagctgttcttggcctcctttatcctctggcggaaggcatcagcccccatgttcttgatgaactcatccgggtctttgtggggcttcatgttcagcaccttgatggacatgcccacctccttaaggatggggatggccctgagggctgccttgataccggccccatcgctgtcataggtcaggatgacctggtccgtgtagcgtttcagcacattggcgtgctggctggtaaatgccgtccccagggacgccaccgcattggtgaatcccgcctggtgcagggaaatcacatccaggtacccctcgcagatgagcagatatccttccctggaagtcctggcataattaaggccgtacaggttgcggctcttatcaaacagctttgtctcgggggaatttaaatatttgggttccccgtcccccatgacacggccgccgaatccgattacgcggttattcacatccatgattgggaacatgacacggttccagaacttgtcccgtcccccgcgctcttccagtgtcaccagcccggtatccttcaggaaactgtcctcataccccttccccttcaggaaacggtacaggtcgtcgctggtcttattggaatatccaaggccgaaatgcacgatcgtatcatccagaagcccccttctgtcatggagatactcatatccaagcttaccctggggctgttttaactggtaatagaaataattggccgccagtttattcacttccagcagcctggccctgtgttccgcctgctccctggcctccttgctgtactccatcttaggcaggctgaccccggcccggtcagccagatgggccagcgcttcctggaacgtgtagttttcatattccatcacgaaagtaagtacattcccacctgcgccgcacccaaaacaatagtacatctgcttgccaggagacacggaaaaagatggggacttctcattatggaagggacagagtccaaaataattggcgccctttttctgaagctttacatatcctgaaatcacatctacgatgtcgttcttcattctcacttcttctatgacttcatctggatagtacatgtatgaatctcccttctgtatcttaatgctgccttaatatacgttccaccgcttggggacaaacagttcctcaaactggtcaatggcataaatatcgctcatgcccgcaatataatcgcagaccacccgcgacttcttctcccctgtgtttacaatgagcaggacatattccatgggcagcttatccacatgcttcatgtaataatcataaagctgcgtgatcatctgctgggccttgccctcctctgccttggggatgtcgttcttataaacattgtcaaacatccacttgcgaaggccctgcatggcatcctccatgccctcggacatgcgtatctccggtttatccatgctgttgaggataatgtcgtgaatcatggtattaaggcgctcacgcacgctgcgtccaaggacatccgtatactcacagggcagatcctcctccttgaacatcctggcccggatggcatcgtcaatatcatggttgatataggcaatcttatccgacagccggacaatggcgccctccagggtggaggggtggcccgatgtcctgtggtttaagatcccgtccctcacttcccacgtcaggttcagtcccttcccatccttttccagcacctccacgatgcgcacgctctgtttataatgcgcaaacccatcctcacagatcttattcagtatgtattccccggaatggccaaagggggtgtggcccaggtcgtggcccagggcaatggcctctgtcaggctttcgttcagccgcagggtcttggcaatggtcctggcaatctgggatacctcaagggtatgggtcagcctggtccggtaatggtcgccctcaggcgcaaggaacacctgggtcttgtgctttaagcgcctgaatgccttggagtgcagtatacggtccctgtcacgctggtattcaggtctcatgtcacataaaggctccggcttgtccctcccccttgtcctgctgctcagggacgcatagggactcatatactgctcttccaattcttccagtgactccctgatattcatcctcccactccctatctctattattatattgttaagtctcccattttactacaaaaatttcatttttcgtgtcacaatcccatatcttgtctgtaaacatgtacctaatgtccatattatatcacaatatatgaatatttcatatgggcagactccctgatatcaagttaatgttacaaagttttggagcctttttcaaggctccaagtctgcaaaccagcataacttcgtagggagtatggtaacttagtgtcaagcaagacagctatttatggtaaattagtgctaagttagtatttagaaaatataattgatgaatcaattttttgtattgatatagtcatctttagtaaaaatgctacaatcgagtgtaatgataatatctaaatatttccatacattatccgtttctattctcttcatcttctgttaaatctgattcaggaaattcactggcaagcttatccgccacttcctcccaataattaacaatgtcttttgtaattactggaataaagtgttttagaaaacataaaattaatctctatttttgtctcccaaatacatgttttctaatttctgtttctcttttaaattaagtttctcctctaaaatactcatgtactacttaccctcttctctattaagcaaatcagaaattgtccactccccgtttcgcacatttgatactctccgatattcataaattgcgtaaatcagtatatctacgttagagaagtatgctttaacaaaatcatatgatttaatctccttgcccttcatcttagctttgcaaaattcacttggctttattcccgattttttaaattcggaatacaacccttcattcaaaataatcaacatttcaatctcaggtgccgttataacgttaataacatcaactttttttgcataagctggactgagcttaaaattttctcttctggaatctaaaactctataaactgtgattttttctgaaaatccctttttcaaatatcgttcttcaaaatccttaccttttctacaccgaaggatctcttcttcaatcaggttttctttttcaaaaatcaatttattgttctctaaaagcaaatcaagtattgcacgttctgctccaccttcacaaatacaagctatatatttccccaatatgtattcctcctctagttacgatttatgaggacttttttcaaggcaatataagcttcataggttggaacggttccttctaaaaagtcactttgatatgcttcactttttttaatatcattcctttttaatatattcgataagttctctgccgaaataccattccggttcctaacaataaaaatattatcatttcgttcaaattcatctaatagttcggaataatgtgttgagaaaataatgactgcaccatttttattgaccttagaatcccggaaaaatcgaatcaatgtggaaacaatctccctgttaaagtgattttccacctcgtctacaataagatatcctccatcttcaaatgcaaaaaaagcattcataaacacactgattccttttatagtgccggaagaaagatatttgtccaataccattggattgttcattaagatttcttcttttcctttaaatttcaaccgaatatcaacatctttctcatctacagcacattttaaatattcaatactagggtcgaggaatagtaaaagctctttcggaaatttccccagcaaattcagcatattaaaatttgtccatttcgacatgtcacacaggaacactttcgatttatgctttttattaaaagcaataattatactgacatcatccatcagatattcttcgtcctgatttcgtttcacagcaggaatgccttgaaaatcaaacatccccttcttcgtttttatttttgtcgatttctgtgaccacaggttttcactttcaatcatatatctggtattctcatcgattggatttattgtcttttttataacagtttccaatttgttaagcaatcctgaatgataaaaaaacgtagtaaaagttacagtttgctcatcattaatatcctctaaaatttcctttgtttcaatcgtattgattggcttattgttcaataaatttatcacaaaagctatcactcttaaaattgtagtttttcccgatgcattaatgccaataaatgatattgaattattaacataaatatttgagaatatctgatacaatccatcgttattctctgactgcactctctgctgtgcaaaaaaatcaatttctaaattttctttaaagtgaggtaagccacctacttgtattttaatcagtttcataatccctcctagaatttatctacaagattttcgtttttatattgttattatatcctctttttttacttttatcaatatttatttttaaattttacgttattatattaaatcggcaggctgtcccgcacacacagcgccccataccccagctgcggattgggccaggtcccgtatcccggcaggtgcctggctccccgggccagatatgcctttaccttctccccgtaaaggaaagggtcgtttccatccacgattccccactgcatgagaagggccgcgctgccggacacaaagggcgccgcaaaggaagtgccagtcaccgcctcataaccaccgccgcttctggccgtcacgatgtccaccccaggagccgcaatgtccggcttcacctgacgtgtctgccgcgtaaaaccgcgccctgaaaaatccgcgtatgattggtaggaatcatcataggcgcccacggatatcacattggctgccgtggaagggatggtaagggtggtctccggcacaggcataaggaaccgggtggagggattcaggattcccctggagggcagccacatgtcgtattgtcccgtcacgatccgctccggcgtaaggcggaaggtccaaatcccgctgtccagatagtcccttatggggatgaaatcaaaataaacttcctgcgccttgctgtaagggctgggcttgccataataaatcaggattctggtccccccgtaattcagggtctggggccccagacggctgtctatgggaccgatggtgccgcctgaaggcgtaatcagacggatggcaaacccgtccacataggatttccaaagctggactcccatgccggtctcaaaaggcgcaatggataattccacatccgtgtcactgcccatgaccagccggcccgccgtgtgcccgtttccagtgccttcatttccagtccctgcaaccagcacgctccttccataattcgatatatcgttcatgaaggtttccagaaggctggtgccgtcatgggaaccataggtgttgccaaaactcaggttgactgcaacaggacgccccagctcctgggcctggcggattacaaagtccagccccttcatcagctgtgtggtccttgggaaattatcagccacaggggcgcccagttttaccaccaataagtcactttcatacgccaccccgcggtagacaccctggcttccccttccattcccggccgcaatggctgccacggctgtcccatggccgcttaaatccacggaaggcacaaggtcaagggcgcctgcccggtcagatgcgttcagcgcctcattgatttcttcccgtgtataaatcctgtccctgtcctggtccatgagcatgaggatcctggtactcccgtccgcattcctgaagtcctggttcagatagtcgatgccagaatcaatgaccgccaccagtacaccgcgtccggtcagtccgcccggcagtccgcttatgaccccgcccgtcacattgcccgcgcctgagggggattggaccacggaaagacaggaggccgcccttgccatgttgctggcaaagaacagcctctttggtttctcaatatattcaatctggttcagctcactgacctggtccacaagatgttccggcaccacaaggacagcgtacccgttaagaagttcatccacctggattcctgaccctgcaaggcccgcaaggctgcctgaatgccggacaatcagttcccatgtccgttcttcagggtcataacccacgtccaggttttcggagcgctcccgctcctcgtccgtggcgctaagggccagattcagtagattttcccgtttttggttctgcatggttgttctccggcattccttatcattagatgctattgatcaatgctctaaattattccaattatatggggatgcctggaatggatttacaagcacgcctaaatgcatttccccattcccatgcttatccgcggaccgtcatgtagatgttatagaaccctgtcagggtcaccaccaggaccatgatcggtgtcaggaaacggatgcagagtatccacagttttttaagtttaaaaggtatcccgtctttttcgatttcatccaccaagttgttggggtcccatttccatccgatgtaataacacatggtcacgcctcccatgggaagcaggatattgtctgttatcattcccacaaaatcaaatacgctgtagtttaagatggtcacattgcccagtgtcccaaaggaaagggcgctgggaattcccacaaggaaacatgccgtcccaagaaggatggtcccggtccgccggctcagacgcatggtgtccagggcaaaggaaaccgttacttccagcagggcaatggcgcttgtgactgccgcaaagaatacaagggtaaagaacacaagggcgaaaacgggaccgaaccgtatggctgagaacaccttgggaagggttccgaagattaaccctggtccctgtcccggttccaggccaaaggagaacaccgccgggaaaatagcggttcccgccatcagcgcaatgatggtgtcaagtccggccacgctgagacagctccttgggatattctccttgtcgctgaggtagcttccatatgtgattgtgatgcccatgcagaggctgagggaatagaacacctggcccagggcagcgctgaccgccgtcatgttaaaggctgagcggttcggtatgaatatgaacctaagcccctccgccgcattgggaagggtcacgccccttacgatgatcacgatcagcagcaggaacagtaagggcatcatgaccttacttaccctctcaataccgttgattccgaaacagcagatgaccgtggtcacgaacaggaacaggaaatgccagaataccggttccaccggggagctgataaaggcggtaaagtcctcaggcgcctgataggtggacgcatagctgacaatgtattttaagatccatccgccaatgacactgtaataggacaggataagaaatgctgccgccacgccgaacacacccacaatacgcgcattggaattgatgtcgccataggcctgtaccgggtcatggcgcgtacgtcttccaagggacatttcaatcatcatgaccggtatgcccagtatacagataaaaaacaggtaaacagccagaaaggaggctcctccgttgcgtcccatcagataggggaatttccacagattgcccagtccgatggcagcgcctgccgtagccatgataaagcccagtttactggcccactgattctttgtcttcatattttagtcttcctactctcttgtgcgtttttttataaatataaataccagaccgctgacccccatcaaaatggggtaaaagcaatatgggataatctcaaaaggcgtgaggcccgtcagggtcgccgccgcaaggagctgtgccccatagggaatcagcccctgtcccatggagctgaacatgtccagcagggaagcgctgcgcctgggagtcacgccaaagtcatcgctgatttcctttgcaataggcccggacatgacaatggccaccgtgttgttggccgtgcacatatccaccaaaagggccagggcggcaattcccagctcccctccccgttccccgttaatccttttcctgataaaggacaggatgaaatcaatgcccccgtactcctttaccagggccacgatacaggccacgatgatggaaatcacagtaatatcatacatccccatgattccctcccccacatgggtgaacatgtcccccaggccgaaggctcccgtgcccacgcctgcaatcagggacagcaccgtgcctgcaatcaggacgatgaatacattcacgcctgccagggcgcccaccagtaccaccagatagggaaggacgcggaatatgttgtaggtcagttcatcctttagctggaaagcagcgtccctgcccagaaccaggaacagcaggatggtcacgatggctgccggaagcactatcaggaaattctccctgaatttatccttcatctcacagccctgggtctttacagcggcaatggtcgtgtcgcttatcatggacaggttatccccgaacatggcgccgcccacaacggcgccggcgcatacggccatggaaaacccggtcttctggctgattcccactgcaatgggcgccagcgccgtaatggtccccacggaggtccccatggatatggatatgaagcagccgataaggaacagtcccgccaccgccacattggacggcaggatggacaggcccaggttcaccgtgctgtccacgccccctgctgcctttacagcccctgtaaaagcgcctgcggccagaaatataaggcacatggttatgatgttctcatcccccacgccttctgcagccagcctgatcttatctgcgaatcccagctgccggttctgtacaaaggcaaccagaagcgcaattaagaaagcagcaatcgccggcatgctgtaaaaatccccggtaatgaatccagaacctaagaatattaacagaaacaccagaatagggagaagggcagacgcccttccctcttttgtattccccatcatataatccccctgtacatcgtgtccgcccctgttacttcaggaagccattgacaatctgggcctctgcctcttcctctgtcagccccagcgtcatcagcttcacaatctgctcccctgcaatcttaccgattgcagcctcatggatcagggcggcatcgatatcattggcaatcaggcccggaatggcgaatatcttggcatcatccatgatgatggcatcgcactccgtgtgtccgctgcactttgcattgcctacgattttggaattgaaggtctgctttgaccggtcctttgcaacggaacgcgataccacgtccgcgctggagtcatccccgttcaggttcacgatataggtgctctccgcatcctgggtcccatgggtcagaaggcgctccctgacaatcagcttggcgcctgcggccagctccgccgtgttggtcctgttggtggaatccacgcctttaatctggaccatttccatctccatgtagctgttttcttccatatatacctcggttccgggattcaggatacgcttaccctccccatctccttcgccgtaatgcttttccacgtatttaaccctggcattcctgcccacgaagaaacggtggatgccgtcgtgttcagaatcctggtccccgcagttatggatgccgcagccagccacgatgaccacatccgcgtcatccccgatgaaaaagtcattgtataccatttcctttaagccgctggcgctgaccaccaccgggatatggacgctttcatgctttgtccccggcttgatgcgtatgtcgattcctgccttgtccgtcttggtagttatatctatgttggctgttgtggcacgtgctgatgtctttccattggaacggatattataagctccttccggcacgccgtgcaggtcagccacttcttctaacattctctcctgtattgcgtctcccatcattggttcctccccttactgtgctgtctcgtaaaacttactgcatgcatccaccgcggaagcagtacccatgatctgaggaagcacctcatccttggggccctggttcacaacgcggccgtctgcaattaccacgatttcatctgcaatattaagaatcctctcctgatgtgaaataatcaggatggagccgttggtgttctggcgcatacgctcaaatacctgaatcaggttctggaagctccacaaatcgattccggcctcaggttcatcgaacacggaaagcttggatgccctggcaatgacagacgcaatctcaatcctcttaagctcgccgcctgaaaggctggcattgacttcacggttaatataatccttggcgcagaggcctacctcggccagatactgacaggcttccgccacgctcagcttcttcttggccgccaggcgcaaaaggtccagcacctgcacgcccttaaagcgcaccggctgctggaatgcaaaactgattcccaggttcgccctgtccgtaatgcccatatccgtgatatcctgtccgtcaaacaggatacggcccccagtgggcctctctattcccataatcagcttggctgtggtggacttgcccccgccgttcggtccggtgatgacaacgaacttcccatcatccactgtaaggctgatatccttgatgatccccttttctcctttttcgtcattcacatcaaaggagagattctctaatgtaagcattctgtttcctacctctctttatctcttctttttatttccgggtacggcaaaaagcctgtcccccctacggtttttaggccacaaattacagtataaactatttcccaccaaattactatcaaaactttacctcttatggcagaaaatgtctgttgcaaatgcaacattgctagttttcccttaaaaccatatttatatttatgtttcaagggaatattcccctgcatgcaaaaaaaaacaggaagccatcagcttcctgtccgtactgcagaagaagggagtcgaaccctcaaggtattactaccacacggacctgaaccgtgcgcgtctgccaattccgccacttctgcgttacgctgctctcgcaagcaacgtaggtaattataatagatgaatcgaaatttgtcaatggctttttaataaaaacttttcaaagaactcatccatgggaatgggctttgaaaaatagtagccctgcccgatggaacaccccatctccgtcaccatgtccagctgttcctttgtctcaattccctcacacagggaaacaaaacccattttgttggtcatctggatcagctgccttaagaattcccttcccctttccgtattccggcaggactgtacaaagccacagtccagtttaatcacgtcactgggaatatccgccatcatattcatgatggaataccctgaaccgaaatcatcaatggatgtggtaaacccgctgtcccgcagttccttcatcacgtggaaggtccggtccgtgtctttcaggaatgcggtttccgtcagttcaaactccaggagcccgtggtcgatcccgtactcctgcgtcccctccatgatatcggacaggatactgtccatccggatatccacactggaaaggttaagggagatacagacaggtcgtacgcctttgtccagccattcccggagtttcctgcatacctgcctgaaaatacttaaatccatctgtgaaataaaaccgttcttctcaaacagaggcaggaactctcccggcgcaatgatggtgccgtcctccctctgccatctgaccagggcctcggctccggtcagactgtggtccttcagtgaaagcttgggctgcaggtacaccttaaactcatggtgtttcagtgcgtattccatccggttgatgatttcattttcccggaaactgctgtcaaatggaccatcattaaacaccaccacggcggactgtatgatataatccactgaccgtctggcaatattggccctgtcaatggccgcgtcaatctccctgcattccctctcaatgaaataaatcccggaacgcaccatgagattgacattcgtgaacatctggttctgtatcctgcagaaatccccattcaggcgctggaccatctccacgaattgattccggtccatcctgcatatgccaaagcacaggaactggtccgcgcttacccttgtgtaacggttttcctcccgcccattctgtgtcagcatgtctgcaaacatgcgcaggatattgtccccctgggtgtaccccactgcctcgttaatgaatttgaatcccttgatatcactggcaatgatgacatatccacctgccccggcgtccattatcttctggcactcatccttaaaacaggcataactcatcagtccggtaaggatatcccggtttttataatattcggccttctgcctggcctccatcaggcgcagggatgtcctggcattggtccccaccaccttggccagctcagatatggcgctacgctctgactgtgtccactccctttcctcctccgtattcacaagcaccatcatcccaacgtaccttccatcgatgaaaatgcccgcaaacagcatggtctttgccctggcccggtccatgatccttctcatgcctgtattgtagacttccagcttgtcccggttcagcacggcaatcccatcgctgtcatacagattgtaactgagataaaattcctcctgccggaatgaatccgaagggtcaaacagcatggccgtcctgtcatccacccactggtaagcgctgtgtccctccccttccctttccccgttcatgtaaatggcaatgcggttaaggcggaaccggctgccgataaagcccatgaggatatgcagcgcctcctcaaaggaggaggtcttctcaaacacctccagggcaaccgctgtgctggtctttccctgcaggctgctctgctccttcagctttttatcattcagttccttcagccgttcataggtaaatatatcatcctctttatcagtgacagactcatagaagcggaccccgcccttgccatccctcttaacctggtgcatggcctggtccgcctttaccatgatatcgtaaaagcccttttcatcctccgcaatcatccggccgccgatgctgcagcccaccgtcattcctccgtactcgctgctgtccagtataccgcttatctcccggacaatgagcgccgctgtccttgatgcttcctccatgtccgtgtcctttaacagcacaaggaattcatccccgccgaaccgtccaatcaggtctccctccctgcaggtgcgcttcaggcagctggcaacattcatcagcacaacattgccgaacagtttaccgcgggcctcattaatcttatggaaatcatccatatccagcaacagtgccgctgtccgctccggctttggcactgttttcaggtattcttccatctgccgctcaaatgcccccaccgtaagcaggttggtaagcgcatcatggtcctccgaagcctcttccttgctgcttcttagttccgtcacatcattgagcacgctctgaaggtggtccagtttctgcatcagtatgttctgtaccctgtcctttaacaggaaggtccccactatctgtgccacataggtgaggactgatatctgttccctggtccagcgccggttctccctgcactcgtcaaagccgataaatcccaccaggcgtccattatcataaatcccgcactgaaggatggccttaatgccctgggaggtcagcacctctttctgtaccggatggagttcctccacatccatgcacaggaaaatcccgttcttatcaaaattatccctgtatcccggcgcatcctcttcataagacatatcctgcagattgtcaatctgcggactgattccctggttgcaccactcaaaggtattactcatgaacagcccgtccgggctgtcctcaaatatatagacacggcttacattaaactgaagccccactatcttaaggatggtattgatggcctgcctcgtatcctccgattcatacagcaccttgaaaacatagtggattaccttatcaccgccatataccgggccattatcagaatctatgtcaggcacgcgccctgaaaatgcctcccacttcttagcgtccaccgaaggcagggaaggttcataaaacacgcatttgccttttcctgtctgcttaccggaataaagggcaatgtccgccttggtaaagagctggtcaaactcccttccattctccggatacatggaaacaccgatacagcatctcagttcaatgggattatcaccggcagcggagattcctgacattccctccatgatgcggtctgcataagccatgaccgcttcacggcttcccatgcctgcgagaaatacaaggaactcatccccgccgatcctggccaccacatcgcttttcctggacacgctgtttatacatccggcggcctcggtcagcacactgtccccaaaaagatgaccctttgtatcattcacttccttaaaattatccagatccacaatcataagggcggccgtcatcctgctcttgcctgcctcttccaggaattccgatatccgttccctggaagcttcccggttcaggagcccggtaagggaatcccttctggacttctccctgtaggtacggatccggttcttatcgtccgtgtcatccagcatcatggcatagaaccagatctgcccttcatcccccttaatgatacgcccacggcaatccacccagcaggtgcttttatccttcctgacaatacggaattccgtcttaaggacctccctgtgctccctcagctgctgtctgcactctgaaagcgcatgatggtagtccttctccaggatcatccccttaagcgtacctccggtcagcacattaaactcatcctcatccctgcatctgaaaagttccaggataccctggttcacaaggtccacccgtctttccttatccgctgtacagcggaagaaaccggccggcatggaatccatcagaaaatgagtcccccattcagcccgtaccccttttatcatttgcccataatcacccatatcaagtgtgcctccgcatacgccgaccttgtgtcatgatttgattatactggagattccaaacatttacaagtgttagaatttaggttttgggagggcggtagggggaggtgcatccgtccgtgaggggaatggcagcgggggagatggacgcggctttggggctagtgcttctaatgctccgggatccggcgctggacaagaggctggctgccaaactcgcgctttgtcttctccaaccatgacggtatcgggctcagacaaaaggcgccagcctcttagcaccggttcccgcagcataagaatcacacgcccctgcagaagcatccatctcccccgccgccattcccctcacccactacgtacctcctcttacacattacaaaatctaagttcgggaggaagataagatttccgcccccttttttagctattctttctcaccatcgcttccctttcacatctttacctcttactctcccgttgtttgattgtttggacgcagtagccggatggcacagcagcctcttcataaacttagctggaggcaggggcgggaggcgggcgggggtgcggggccttgtggagggggtatggtctgctaactcaaaaaggcggtaaaaacagggccgagtgagggcatcaaagcccgaacgcagagcgcctacggaagaaaaatcatcaagatttcttctgtagttggcgcggtgccctgtttttaccgtctttttgagttagcagaccatgcgcccggaaccaggccccgcagccccgcccgccgcccgccactggctctggaaacaccaaaaagcagaggctgcgtacccccgcaaacctctgccttcaaacctcagatcaacctctaagttcaatcccaaggccgccgagtccattcaatatcttattcattaccgcactgacttccttgtcttccagtgtatggtcctttgcccggaaggtgatggagtatgccacggatttatgtcctgccaggacctgggctccctcgtagatgtcgaagagcttatagctttctaagaacctgccgccgcgctgttcgatgatgtcttcaatctgtcccaccaggatgtccttgggcacaaccatgctgatgtcacgggttacggcagggaacttggcaattccggtgtatttcctgtcaaatgtggtgaagtccatgatggagggcatgtcaataacggcaacataagccctgtcgccaattttataattgtctgccacatccgggtgaacttcgccgagaaagcctacaacagtcccgtcatagacaatgtctgcctttcttcctggatgaagatatggatgctccccattgggattgtagtggggcttcttgtgcatgccggctttatcaaagaattcctccacaacgcccttcatggtgaagaaatccccatcgccgtacatacccagtgtgaactgcatgcgctcatccggaagctctgtcagcggaagggctatgggacggtatacgttggccagttcatacaggcgcacatccttgttgcgtcggttgtagttggttgcaagggatgtgagcatcccgttcagggaggtggtccgcatcacgctgaagtcctcgcccaggggattggaaatgttcacggtcgcacgcaggggactgtctgccggaatcagcatcttatcaaataccttggggctttcaaaggaataggtcatgccctgtgagaaaccgcagaactcagcaatctcccttgccagttcctcaatgcgcagcttgtaagacagctttccggtggtcgcctcgccggatggaagggtggttgggatcttgtcatatccatagaaccttgcaacctcctctgccacgtcggccatgcgctccaggtcctgccgccaggtaggggcaattacctcttttgtatcagcgtcatagcccagttctatcatcctgaagtattccagcatgtctgcttccgggatatccgtgccaagaagcctgttaatcctggcagcatcaaatggtatcctcttctcttcctttttcacgggatagatatcgatgatgcctccgattacctcgcctgcccccagttcttcaatcagctggcatgcgcggtttactgcttcctctgccgtattggggtccaggcccttttcatacttgcctgaggcatcagtgcgcagtcccaccttttttgcggataaacggatgttggttccgttgaaacatgcggattcgaataccatggtcgttacgtcatctgtaatcttggagttctcaccgcccatgattcccgcgatgcccacttccttttccccgtcattaatcatgaggatggtggagtccagcttccgctcctggccgtccagggtctggaacacatccccgtcctttgcacattttacaatgatttcatggccggccagctggtcatagttaaatgcatgcatgggctgtccgtactcttccatcacgtagttggttatgtccacgatattgttgatgggacggattccgctggcagccagacggcgctgcatccactggggggatggggcaagcttgatgttcttgaccatccttgcgcagtaacgggggcacagctggctgttttcaacgcgtaccttcaggtaatcattaatatcctcatcattgccggtctttgcgacggacggcgccgtgaaggattttttaaaggtggctgccgcttccctggcaatgccgattacactgtagcagtccacgcggttggatgttatttcatattcaaataccacatcccgcagtcccatgacggccaccgcgtcttctcccggtacactgtcctttggaaggatgtagatgccgctctccggcgcgtccggatacatatcccggtcagctcccagttcctcgatggaacacatcatgccgcaggactccacgccccttaatttgcctttcttaatcttaatgccgtcctcaggaagggcgccgccgtcatggccgcctgccacgcgtccgccgtccaggaccacaggaaccttttcccccaccgaagcttccgttatattgggcgcccctgtcacaatctggacaggcgcgtcagcccccacattgacctggcacaccaccagtttgtccgcatccgggtggcgctcaacagagagcacctcgcccactacgatattttccaggttcttatccagacaggaatagccttccacctttgtacctgtgagtgtcatggcatccgtgtattcctgggcagtgacatcaaggtccggcacatatgctttaatccatgataatgctgtattcatattggttctccttctatattcactaatcaatcatgtatgcatcagaactgtttcaggaaacggatatcgttctcatacaacaggcgcatgtcatcaatctcatacttaagcagtgcaatacgctcaaggccaacgccaaacgcaaatccggagtactcatccgggtcaatgttgcacatctccagcacatgaggatggaccatgccgcagcccaggatttcaatccagccggagcctttgcagaaccggcagcccttgccgccgcatttgaagcaggtcacgtccacctctgcgctgggttctgtgaatgggaaatgatggggacggaacttaacctttgtctctggtccgaacagctcttttgcaaattctgccagtgtgccctttaagtcggcaaatgtaatgttcttgtcaattacaagcccctcaatctgatggaaggaaggtgaatgggtggcatctacctcatcggaacggaatacacgtcccggtgcaatcatacggatgggaagctttcccttttccatggtacgcacctgcacgggggatgtctggcttcttaaaaggatggtgtcgttgatgtagaaggtatcctgctcatccctggccggatggcccttcgggatattcagcttctcgaagttatagcggtcgtattccacctcgggtccttccaccacctcatagcccatgcccacgaagatgcgctccacctcttccagggcgattgtattagggtggctgtggcccacgttattcttcctggccggaagggtgacatcaatcacttccttcttaagctgctcttccctggcctttcttgccagtacattctttgtctcctccagcctggcttcgataatggccctggcgtcattgaccatctgccccaccttggggcgctcctcaggggaaacatccttcatgctctttaaaaggcttgtgagttctccttttttgcccaggtaggacacacggatatcattcagcttttccagcgcatcggaagcttcgattttctttaaggcttcttctttgattttctctaactgctctttcatggcttctccttttctaatctctgttgggtgtaatccgcggcttcctatgttgtcctatgcctgtgaaagcaataaaaaaagccccatccctccatacgaagggacgagacaatacccgcggtaccaccctgattcctgcttaaaggccttgcggcctgtcaatgcagacacttaaacgcatgtaacgtatgctcacgtcacggactacaggaataccttccttcatccatgcagctccagtgggaatttcaacctcttatctgaacctgggcaggctttcagccggtggcctcccctctctggtggaaaataagtgtctactgtacaccttcattgcttttaagatgtaaatctaatgtacattctagccacatcttggggaaatgtcaagaggttttgggatgatttctcatttgacgaaaaccaggttaagggttaaacttatttttagacggaacaaaagaaaggttgtacaactatgattaccaaacatacaataccctgccttgatttaaaacagattgctgaatccgggcagtgtttcaggatgaacccgctggacctggacctgctgcctgagggaacagattacggataccggatcatcagcagggggcgtcttcttgacatatggcagcagggacaggaactgacttttgactgcgccggggaggacctggatttctggctggattattttgatattgcaacggattaccaggccatgattaactgcgtggccccagggaacacgtatctggccgaggccgcgcaggccggaaagggcatacgtatcttaaaacaggacccatgggaaatgatcatcaccttcgtgatatcccagcagaaaaccatcccgaaaatccgccagctggtggaagccctctgtgcctcttacggcaccccggttaacggtgccctggttaatggtgccccggttaatggcaccccggttaatggtgccccggttaatggcaccccggccaacggcatccccgggaaagggccggaggtttccatcgaaggccccgattcaagccagcgcctgttttccttcccctccccggaagagctatcccgcgccacgctggatgagcttaaggagctgaaacttggataccgggccaaatacatataccagttgtgccaggatgcggtatccggcgccctggaccttgccatgctggataccatggattatgatgccgcccttttatacctgacaggcttttatggaatcggtaagaaggtggccaactgcgtgtgcctgttcggcctgcaccaaattggggcatttcccgtggacacatggatagagaaaatccttatggcccagtactatgataaacgcaaataccgccgcacccccaagacatgtctctgcgatacaatcgtaaaggatgtctttggccagtacggcggctgtgccggcgtcatgcagcagtatatattctactatgaacggctgaggaacagcaagctgtcttagaacgtgtcacatcatccccagctcaaatatcttccacttccctctaaagcccgattcttttcccaccgcaaagtccctggtatacgtaccgtccccccactggggcgcctgttccagggctttgtcggaccagcgctgggaaaaatccacccgcaccaccttgtattccttaaagccatactggctggcctgttcatcgtaatatggcttttggtccgcatactccacggttgcaagggtctgaaagccatggatgatatattcttttatataacggccttccctgaagtttaagtcatcctgcccaaagttaaggctttcaagctggtcctgggggaacagcctgacgcacctgtcaaactgggcaaggcccatgtatttgaagtaccatgcagcagccagctgcgcatcatccgatggcattttctcaaacttgacgtgtcttggaagggagtcctcaaccgtgtattccttcaccagatgctccccgcctcttgaccggttgacagcagccaccatgaacatgatggccaggcatgccagggtgatgccgcatatctttaatgcctggggtgagaatttctctttgttcattgctttttcctttcacttgcctttttatccggtctgtcttggtatcacctgataatctgccagacaggtacggataccctcctgggtgtccccgatgcagattccctgcctgcggatccgctccgtatcaatcataaggtttcttgggcaggaggcaaaccgctccgtatcccgctctatcaggccggacacatcgctgcttcccgtcaccgccctgaggaacagggccgccgtgtcaaatgtgctgcggctgttctggctgccaaaattatagaccccgccagggagtctcatggctgcttccatattccttatcacttcccacacatatgtgatgcccctgtaatcgtgtacaggcagcttcaggatccgttcctccctcctggcatccaggagattgccaagcaggccgcagccgcccggacggtcactggacggatagtcatacatccaggtcaggcgcagcgccaccgcgtcgtggagacaggtcaacatggcttcctctgcacgctttttatcccttccgtagacagagcagggacggtgaggcccctcctcccggtttggctccatggaatcggatgcattgtatatctggtccgaactcatgaataccatcctgcttccggactgcctgcacgccttggccatattggaggttccccgcacgttaatctgttcggaacgctcaggctccttctcacatgtagctgtgttggacacgcccgcacagtgcagcacgtaatccggccggattgcctttatgaatgccgacaccgccagggaatcgcttacttccagttccctgtggctcacgccaagggtttcatatccatctatcttcctgaaatattctgaaagccgggaacctaagaatccattggccccggttattaaaatacgctttttcattgtactgctcatacctttcttcagatatgataacattatagcccaggtactgtctatattctttgcgattttcttaatatttacccagacacttttttaaaacaggcagtcagtcctgtctttttccagggtgcctctgcctgcatgaacacaggcccggttcaactggccgggcctgactgatattccaatgttcttttggttcctgtgccttacttgaatatcccctttttcttgggcttttcctcttccggcggggtaataccgttcatggcgtcatcaaaacgccttaaagcttccttctgcgcctggttcatgcgctccggaacctggacaaccagggtcacatagtggtcgccgcgcacattacggctgcgcagggaaggaacacccttgccctttaagcggaccttggtgtctgtctgggtgcctggcttcacttcgtactccacctcgccgtccacggtcttgatgcggattgggccgccaagggctgcccgggcaaaggaaatgggtaccgtggaatagatgctggtatcctggcgcttaaaaatcgggtgctgtgacaccactgcctccaccagaaggtcgccgcgctcaccgccgccggtcccaggctcgccgccgcctgcaagacgcacgcactggccgttatcaatgccgcccggtatggataccttgaatttcttgcgcacggtcttatagcctgtgccataacagtccggacacttctccttgatgatctggcccgtgccgttacaatcaggacatgtctgcacattctggacctggccaaagaaggactgctgggtgtacatgatcttacctttgccgttacacttgccgcaggtctggggtgaagtgcctgccttggctcctgtaccgtgacagcttgcacatgtctctttaaaattaatctcaatctctttttcacatccaaaaacagcttcctcaaatgttatcctgatggaagtctttatattggcgccgcgcatgggaccgctcctcgccctggaagaccggccgccgccaaagatatcgccaaaaatatcaccgaagatatcacccatatccccgccaaaatcaaaaccgccaaagccgccgaagccaccggccccgccgccgccctggtcaaatgcagcatggccgaactggtcgtactgctgacgtttctgagggtcgcttaacacactgtacgcctctgaagcttctttgaacctggcctctgcctccttatcgcctggattggcatccggatggtatttcttggcaagtttcctgtatgcttttttcaatgcatcatcgtctgcatccttgggaacgcccagaacttcatagtaatctctcttactctctgccatgttgtttacctcttaacactctttatctgcataaaggggttagaagccggaataccggcccctaatccccattttcgttcatcttgcattaaacttccttgaaatcagcgtctaccacatcgtcattcggtgcggaggaagcgccagcagcgccgcccatgtcaggacctgcgccagctgcaccggctgcctgtgcctgctcatatacctttgcaaacagcttctgagcgctgttcatcagtttctccttgcctgacttgatgtcctcaacctgtgcgtcagtcatctcttcaacaggagcgcggttgattgcttccttcagggagttaaggtctgcctcaacctcggccttatcgttaggtgaaatcttatcgcccacttcttccaaagccttctcggtctggaataccatggaatcagcgtcatttcttgcatcgatggcatccttgcgcttcttatcctgcgcctcgtactcagctgcttcctttactgccttatcgatatcatcgtcagacatgttggaaccggaagtgatggtgatgtgctgttcttttcctgttccaagatcctttgcggatacatttacaataccattggcatcaatgtcaaaggtaacctcaatctgcgaaacacctcttcttgctggcggaatcccatccagacggaactgtccaagagtcttgttatcccttgcgaactgacgctcgccctgtaccacatggatatccactgcggtctggttgtcagcggcagttgagaaaatctggctcttcttagtcgggattgtggtgttgcgctcaatcagcctggttgccacgccgcccatggtctcgatggacagggaaagcggggttacgtccagaagaaggatatcccctgcgccagcgtctcctgccagcttgccgccctggatggctgcgccgatagccacacattcatccgggttaagggatttgcttggctccttgccggtgagctgtttcaccttttcctgtgccgcaatcatacgtgtggaaccgcccaccagaagtaccttgcccagttcggaagcagtgatgcctgcatccttcagcgcgttctgtaccgggattgcggtgcgctcaatgaggtcatgtgtcagttcatcgaatttagccctggtcaggttcatatccagatgcttcggtccttctgaggttgctgtgatgaatggcaggttgatgttggtggtggtagctgtggacagctccttctttgccttctcagccgcttcttttaatctctggagggccatcttgtcgttggaaaggtccacgccctctgctttcttgaactcagcaatcatccagttggtaattgcattatcaaaatcatcgccgcccagacgtgtatcgccgttggtggacagaacttcaattacgccgtcgccgatttcaatgatggaaacatcaaatgtaccgccgcccaggtcgtataccatgattttctgctctttttcattgtccagtccataagccagcgcagcggctgtcggctcgttgatgatacgctttacatccaggcccgcaatcttacctgcgtccttggttgcctgacgctgtgcatcattgaaatatgcaggaaccgtgatgacagcctcggttacggactcgcccagatagctctcagcatcggctttcagcttctggaggatcatggcggagatttcctgcggggtgtacttcttgctgtcaatatctaccctgtagtctgttcccatgtgacgcttgatggatgagatggtcttgtcagcattggtaactgcctgacgctttgccggctcaccgatcagcctctctcctgtctttgtaaaagccacaacagatggtgtggtccttacaccttctgcattggcgataacggttggctttccgccttccataacagcaacacagctatttgtcgtacctaaatcaataccgatgatcttgctcatagttttttcctcctgattatttggtttattcatgtattatatgttccacccaacaaagtccgtaaacccggtcaggtgcctaatgccttagttagcaacttttaccatgctgtgccttacgacgctttccctgtacatgtagcccttctgtaattcctctgccacaatgttctcgcccaggctgtcatcatccacatgcatcaccgcgttgtggaagttggggtcaaactcctggcccacggcttcaatcgccttcacgcctgcttcctccagcgtcttctggaactgcttatatatcttctccataccctcggcaatggggctgcccttttcatcctcgggtacggtagctaaacctctctcaaaattatcaaccacgggaagcatacgctcaatgatatccctggcccccatttcgtacatggtggatttttccttttcgcttctcttgcggaaattctcaaattccgccatctggcgttttacccggtccgtaagctcctctattttctcatcccttgggtccttcttctttttgaaaaagctctttttttcttccttggcagaagcagcctcttcagtatccccggatgcctcctccggcgtcccttcttcctgctggcacgcatcctctgtgccgtcacaggccgtctgcccgttctcagccatcacttcttcctgccctgtttctttggcttctgcttctttttttaactcttcgtccttcatatcttcactcacagcttatcacctttcatcttttttaaatgccgtatccagctgattcataagggtacgcagggtgcctaacaccttctcgtaatccatgcgcttggggccgatgattccgatggttcccctaaggcctccgcccaggtcataattggcagtcaccacgctgcagtccttcatggactgtaccgggctttcatcgccaatgtaaacctgtatgcccgcatcgccttccacgcctgcattgacttcagacacaaactcctgcagcacttcctgatgttccaatgtaccgatcagctggctggccctctcaccttccgtcagttcgggatacttgaaaatgttggttgctccgctggtatatatctgcaggtcttccccgcctgcccggatggcttccgccacctcattaagcaccaggtccactacctggctgtggatgcccgcgtcaaccttcagcttactgatgatatccagattaatctcttcaatggtcagtccgttcagactgctgttcaacaggatgttcaggttcagcagctcatcatcggtcagctcatcggacacatccaccatggtattcttgatgatgtttccttccaccaccactaccaccagcattttattcttctccaccttggacagctggatgaacttaagcttggtcttgtggtaacttgggccgcttatcatggctgcgtagttggtgttggaggcaagtacctgggccatcttcttgaggaccagttccagtttatcaaccttctggaccatcatctccttaagctccgttacctcgctgtccttctccaacataatctggtccacgtaaaaccggtatcccttatcagaaggaatacggcccgcagatgtatggggctgtatgatataacccatctcttccagatccgacatctcgttgcggatggtggcagaactgagttttaaatccgaatacttggaaatggtcctggaacccacgggttcccctgtttccagatacgttttgataatcgcctttaatatggtcatcttcctgtcatccaggaacgtatccaccggcatctgtccaccttcctctccgaattattagcactcggtttcgaggagtgctaacatctacattccataatatattccttctgagtgaatttgtcaagagataaatccaaattcttttattataatttatttttccagtttcacaggacatagatgatgtagtccccctcctgaaaaatacctatatatttgattttatctcccacttttaacaattttcttgcaaaaatatgtaaaatattccccactttttatgaatatgtaacacttgtttaatgatttcagcttgacaattaatagttttgtaatataatgaaatatacatataatatagtcatatggaaccagaacaatctgttaatattgcgaggtaaatatatgcacaataccataagaaaaaccgtcctggccgcggcggctgccgtcttatgcctggcagcttccttgccagcttatgcagaagaaacatcccatacggatgtggcggtaatgaaggatgaggctgccggcaaagatgggaccacgtctgcgtcagtgggcaaggacgtgacagttgttgagaacggattcccggacagggacacggaacatggttctgcgcaggataccgcagggaccagaacctcccataaggacaggaccagccgcggttcagaagaagaatacgtggacgcgggtcccggcgccaggaagaaggaagaaccgcctgtttccacggaaacctcccttggcaggttcaccatcaccggttactgcggatgcgataagtgttcgggcggacacgggcttacctattccggcacggttcccacgcctaaccacaccatttctgcggacctggaccagtttccgctcggcaccaggctgaagattgacggaaccgtctatacggttgaggataagggttcttctgtcaagggtaacattcttgatattttttacggcagccacgaggaagcgcttgccaaaggtacctataccgcagaagtatttttaatggaagactgattttcccgctacatacggacattttgaaagccaccagcatcaaaggctggcggcttttcttttttgccctgggcacagggttttccggttacatatccaagaaatttcctttatttccatatatttccttgacaatacaggaaaattatgataaaaccttgtttattgctcatatattacaaaagtattacatataatttattaatatgttaagaaactattttgaatattaaatgagcaataggaggtaacaaataaatgaaattcagacacttattaaccggaaccattcttaccatcagcttacttgcagcttctgccgtcacggcatttgcagctgtatccaaaggacgttttgagacagttgacagcaccaccatcagcggctgggcatacgacagcgattcccctgatgacgcgttaaacgtaatgataaccatcaagaataaaaatacaggtgaggaagtattttcccagcgcatatccgccggggaatacagggaagcgctttataaggaaaaccggggcaatggatgccacggcttcaccatcaatgtggactggagcgcttatccggacggcatatacctggtagagggaaccgtggggggccgaagcttccccaatcccaggacatacaccaacggcagcggggatgcccagacaggaagcgctgctgacggacaggggctgataccccttggggtctttaaaaccaccggctactgtccctgccgcgcctgttccgagggctggggacgccatacatgtaccggcgccgtcgccactgccggacacaccatcgcagtagacccaagggtcatcccttacggctcaaaggtcatgattaacggtgttgtctatacggcagaggaccgcgggggcgctgtgaaaggcaaccacatcgatattttcttcaatacacacgctgagacgagacagcatggaatgcagaacgccgaggtattcctggtccagggatagacaataagatataacgtgatgattgaattctaagtgctgcgtcctttaaaaaacggggcggatggcagcggacagggccatatggaatagcccatccgctgtcatccgccccgtttcatatcaggactgcattcctatccaggtcctatccgccaatttcccggagttccgtcccactgtaaaagaacttcaggatggattcatagtcctttccttccttggccattccctgggcgccgttctggctcatgcccacgccgtggccgaatccgcctccatagatgtggaaggatggctttccatcctctcctgtccttttttctatggaaatgaaggcgctgggaagggtcgcgcttccttccattgtcttgccgtcctgtttggtaatgacaatgcccggattccccagggcggaacggatggcgccctgtcccttgacagtcactgtcccgccgcttcccgacacgctcagttcgctggcaataccgcctgccccccgccccgtgatggtcatgtccgtgactgctccggccccatttatctgggccgataccatatcgctgcttatatctgtctcccagcggaacatggcgtaggaggagtcataggctgtcacgtccctgcttcttataaaggaatcaaaattgtcattatcccctacgtccaggggctgtcttcccgccttcacctccactgcctggagatacgggtatttctgcgggtccgtgccccatacgcctgcgtctgcggtacggccgcaggaggtggagaaataaaaggcgtcgattggcttatcctcgtagaaaagcatcctgccgtatgtctccttgacggcctgtgtggtcttctcatccgcctgggtgttgttatatacctggaaattcgtactgtcatccacatgggcgccgtactggctgtaggaattgccctgaatctgcctgtatgcataggtcctggcgcatacggcctgggcctttaaggcctccttttcataggagggcggcatttcgctgggcactaccctggtcaggtaatcttccagatacaggtcattgaccagcaccagtccctcatcgcattccttgatttccattttcccggtgtagaccggcgtaccctggctgcgctcaatggaagtgaccgtgaccccgtccgggttatccgggtttatgatgatacggccgtatttaagcctgtcatcccctggctggatggttaacccggttcccgcctccaggcgctccttctccgtcttgcctttggagttctcatattccatctgcgccggactattcagtacaaggctgaccgatggatggtacaggtttttaaatccggtgtccatgatcaggacacggatggtcttggcgtcaaattcccgttccagcagcgctgcacacagttttccgtccgccgccacaaattcctgcaggtcataacccaccaggatatcatttatacctaatatcttaaaatccccgtaaaccttgtatacatggaaattctcagacacaggtatctcgccatatccctcaatctcaatggcattctctgtaacagaaagtaccttgccgctgatgcgttcctttttcatggtaatcttcctgagtctgccgccctccatgtgaaggtccgccaggttgcctgccatgtctgatacatcgcccagcttttcgctgacagggaattcgcggtaggctgttcccagatacgccttgaagctcctgccgtctgtctcagacagccatatgttctcgtaaacaacatcctctgacaccagttccctcatggcaatcatctcgccgtccctggcaaggaaccgtatctcacagtccaggtacgcgtccagggcaagtccctggaacccgaaattgccttctgtcgtgtatgcggtccagctctcggcctgcaaaaggttggaaggcgtgccgtaaagcaccgcgtccaccatcttcacggccccgtccgggtctgtctgggacctgataccctcatagagcctccaccactcctcctccggaaatgccctgtccttattatgtttggtggccccggcctccagcttaagcctgccggaaacctgtccggccataaatgccgcctcctgatatgtaaggtatccctgggccgcagaaagggtgggcggcgtcagctcctcatccagatatccctcgtcatagaggtaatccatgtatttgacaaaccagttgtccttttccttggcagaaaaataagagcttccccgctccttttcccggcttgcgcattcttccttggtggcaaccgccaatgccatggccttaaacgcctgggccctggtgattccgtcctttggcggctccatggtcactatgattaccatcagtatgatgacaatggaaacaacaccggccacccatgcaatcatcttattcttcatattcatatatccgctcctgtatcatggggagtaaaacgaatgaaagcagcgggtgcaccgctgcttttatcatctgtaaccccaaaatgccgtctcttacttattgacgcctagcaatgctaggtgggcaacctcacttaaacttctgccttccactcaaaggaggcctgacatccgtttaaaaatattggaatcccttgtgtctaatgtaggttcaaaattggtaagagtgtcgaacattccaggtaattacagacgttcatcatttatcttggtgttattataccccaaacatcagcgtttttcaagctgatttttctgaacatttatggaagtttttccaatcacccaaacctttccaccccatattcagaaactcttgcgtatataagggtttccggccccggcgcatcctggctgatggtacaggatgagaggaatttatccgcgcccgcctgtatccgctcctggctgtccgcgtaaaggaccgcaaggacatccccgggcattaccttttcgccgtactttttctttaaaatgattccggccccatagtcaatggcgtcttcctttgtattgcgtccggctcccaaaagcacggaggcgattccgatgccttctgtgtccatatgggagatatagccttcctccggcgcttttacctcatatgtacaggatggggattcaaactgttccggcttccatatgaagctttcatcgccgccctgggcctttaccattgaagccaggcacttaagggcgctgccgtcatggatggattcctccgccatcccccggcattcctccacggtccccttgccggccatatgaagcatgttggccgccagctccaggcataccctggttaaatcctctggtccctctccctttaatgtgcggatggcctcggtcatctccagggaattgccgatggcgtatcccagggggatatccatattggtaatcagggcgcagcacctgcggcctgccaggcatccgatggaaaccatcttctgcgccaggctgatggactcctccagggtcttcatgaatgcgccgctgcccgtcttcacatccagcacgatgctgtcgcttccggcagccagtttcttgctcatgatggaggacgcgataagcggtatgctgtccaccgtggcagtcacgtcccgcagcgcatatagcttcttatccgcaggcaccatgttgccggactgtccaatcacggcaatgccgttcctgttcacgatatcaaagaattcttcccttgggatggccgtcttaaatccaggtatgctctccagcttatccacggtccctcccgtgtgtcccaggccccggccgctcatcttggccaccttcacgcccagggaagccaccatgggacctgcaaccagcgttgtcttgtcacccacgccgccggtactgtgcttatccaccttgattccctcaatgggagacaggtccaccatgtccccggaatgggccatctctaatgtaagatatgtgatttcctggtcattcattccctgaaaataaattgccatcagcatggctgacatctggtagtctgaaatccctccatccacgaatcccctgaccatataggcaatctcatcctttgtaagggcgccgccccgcttcttggtctcaattaagtcatacatcctcacagtatccaccgcctttcacagcaccaatccttatttctccaggtcatccggtccaaagctgtccggcagaagctgttccagggtatattccctgtaatcctccgcgctttttgccaccaggatccggaaggtggacggattacagaattccctcatcacctgcctgcacacgccgcagggcgtacagtaatcctttatcaccccatccggcccgccgcagattgcgatggccgcaaaatcccttctgccctcgctcaccgccttaaaaaatgcacaccgttcagcgcatacgctgggcgtataggacgcattctcaatgttattccctgtaaagaccgttccgtccccgcagagcagggccgcagagacatgaaaatgcgaataaggggcataggatctgggcagcccgtcaatagctgcctgtatcagcttctttctgtccatccgcgctccccctttccgccttggccagcttgacaatccggctggttcccagacgttctgcgcccaggttgatgaattcctccgcatcctcaaaggacttaatccctccggcagccttcatgcgcacgccttccccgatatgcccagagaacagcctgatatctgcaaacgtagcccctgccttggaaaacccggtggatgtcttgatgaaatccgcccctgcctgggtgacgattccgcacatcttgaccttttcctcgtccgtaaggagacaggtctcaatgattaccttcaggatacggctgccgcaggcagccttcagccgggtaatctcctcttttatccggtcatatgccttgtcctttaagtcaccgatattgatgaccatgtcaatctcatccgcgccgttggcaatggcatcctttgtctcaaagaccttgaccgccgttgtattatagccattggggaatccgatgaccgtacataccgccatccggtcccccatatattcctttgcccgcttcacataggacggcggtatgcatacgctggccgttccatacgccatggcgtcgtcgcagatttccttaatctggccccatgtggcgtcctgccccaataatgtgtggtctaccctgctgtaaatctcttttctgtccataggttcccttctcctttttacattaactttaatcggctgtttcctgttaaacagcctgattttgtcttagatatttccattataatacaatccgcattcctaaacaagggaaacaaacgtcccctccacatacgccctcagcgcttccggttccagcgtgacctggacgccccgctgtcccccgctcaccatgacggtatcatatagctgcgccatctcttctatataagtagggaaatgtttcttcatcccaatgggggaacagccgcccctgatgtagccggtcactgccagcatatccctgacgtggatcaattccaccttcttttcccctgctgccctggccgccttcttcaggtccagctcctcatccacagggatgcagcatacaaggtagccctttttctcgccctttaacaccaaggttttatacatcctgtcatgttccactcccaaaaggtccgctgcatggctgcccgacaggtcgttttcatccacctcataggttcctgtcccataggcaatcccagccgcatccaaaagcctcatcacatttgtcttaaccatcaagtccactcctgtccttcatttacattccaacccatcataacccttttttgtatatcagtcaatgcagtccgtcatatacaaggcatatccccacattcgcattccgcctattcacaaaattggatgtaacatttataataggagaaggaacgtctgtgttacatcaaaacaagcacaatcagaaaggaccttaacatatggaaagaaacgatatcatcatcattcatggcaaggattataaaaatatggcaaagaaggtgctggaacaggccgatgtggccggggatatcggcagcagggataagaaggtggcattaaagcccaacctggtcacggccaaggccccgtccagcggagccaccacccacagcgaactcctggccggggtcattgaataccttcaggagcacggattcaaggatatcactgtgatggaaggttcctgggtaggcgaccgtacgggagaggcgttccgggcagccggatatgaccgggtatgccgccattacaatgttccctttgaggacctgcaaaaggatacctggaaggagtatgacgctgccggaatgaagatcaagctctgcgacaaggctgctgccgttgactatatgattaacatgccggtgctcaagggccattgccagaccacggttacctgcgccctcaagaacagcaaaggaatcatccctaattcggaaaaacgccgtttccacaccctgggccttcataaacctattgcccatctgaacaccatcgtccccggcggcttcatcctggtggacaatatctgcggggacctggattttgaggaaggcggcaatccggttgtgatgaaccgcgtgctgggctttaaggacccggtgctctgtgatgcgtttgtatgcggctgtatgggatacccggtggagacagtgccttacatcaccctggcggaacgcctgggtgtcggaagcacggatgttgcccacgccaacacggtttacttaaaccaggcgtctgaggcggacggccagttccgtatgaccaggcgggttgaaaacctggcttcctatgccaggccatccgatgcctgcagcgcatgttacggttccctgatttacgccttggaccgtttaaatgacagcggatacctgaggaagggccttgcgcccatctgcatcggccagggatataaaggaaaagaaggcgccatcggcatcggccaatgcacctcctgctttgcaaaaaccctgggcggatgtccgccaaaggctgctgatatcgtggacttcttaagtgagaactggaaataaggaccgggaataagcatcgggaataagcactggaaataagcactggaaataagcgttccctgccctacagtcccttttcccgcagccatccgacaatatggcctgcataggccttttcccttttcagcagtgtaaaatggtccgctcccttgacaaacaccacctttgcatccgggatctgttcccccatccacagggtatggcggggacgtatcatgtcccggcgtccggtaaggagcagtacaggggcctggatcagggacagttccgctgccgtaagatggggccagttggccatcagtccatttaactgacggcctgatactgcccgttccttcaccctccggggcatgggcagcttctccaccacacgccagaacttataaccggcctttacctgggcataggaaacagccgtcatgccctttggcagcgcattgccgctgacagccaccacggccagcaccttatccggataccggcttgctgcctccagggccacgttggcgccgtcgctaaagcccaggatgactgcctttggcacatggagcacatccatcacctgcatcacgtcatctgccataccggaagtggtaagctcctgggtccggaccgtatccttcagtttcgaagccccatgcccgcggctgtccataaggatgacccggtaataccggctcataagctctgccagccgcccgaatatctggtggctttcaccatttccatgaagcatcacaagaggcactccctgccccagctccttataatataatgaagcaaagcggttgtccgcgtaaccttccttcatctgcatgacctccaaaaattaatatttccaaaagcagataaggcagagactgtgtaacctcacacagcgctccgcctttatcttatggtctatcttctattactgttcgctttttccacatgcacattcctgcctttaatcttagcatgggacatggccttcagcacttcgtccgcatactgtccaggcacatccacaaatgtgtatccgtcatacatgtcaatgcttcccaccatacggcccgggattcctgattcgcctgcaacagcgcccaggatatctcctggcgtgaccctctgggccttgccgatgttgatgaaaagccttgccatctgaccatcgccctcgcccaggacataatcgatggcagccctgtcggttgcccccctgcggccccgtccgtaagcagaggaactgcctctctcacgtccgcgtccgcggcccatgcctcttccaaagctgtccaggtcatccagtgaacgggccggcatggtgcagtcaatgacatcttcattgtcatcgcccatattcatcttgagaagggctgcagccaggtccatggaagtgtaatcctcttctatcagctttttctcaatgatgttcaccatcttggtcaggtcattatcgttcagtatatccattacctggtccagtaccttctccaccttgatttccgtaatatcattcagggacgggatggcctggggaatgatcttggtcttacagtagcgctggatgtcacgcagcttatacacttccttgcccacaaccaggctgaacgccttaccttcgcgtcccgcccttccggtacggccaatcctgtgcacatagtactcgtcatcctgtggcacatcatagttgaataccgcttccacatcgcctacgtcaataccccgggccgccacatccgttgctaccaggatatcggtgcgtccattgcggaaactgcccatgacgcggtcacgctgcacctgctttaaatccccatgaaggccttctgcaaaatatcccctgccctgaagcgcctgcaccagttcatctacctgcctctttgtattacagaacacaatggaaagctttggcgcatacatgtctaacagcctgcacatgacctccaccttgttctttggctttacttcataataatactgggtcactttgggaacggtcagttcctttttgatgacccggaccgttacgggatcgtcctggaacttcctggcaatatccgcaatggcctgaggcatggttgctgaaaacatcagggtctgcctctcttcgggaagctggcttaagatggtttccatatcctctaaaaatcccatattcagcatctcgtccgcttcatccagcacaacggtgtgcacatggtccatctttacggtcttacggcgcatatggtccatcacacggccaggtgttcccaccacaatctgtgtgccgtcctttaaggaacgtatctgctttacaatatcctgccctccgtaaatgggaagcacctttgtgccatgcatgaacttggccagacggcgcatttcctccgccacctggattgccagctcccttgtgggaagcagtatgatggcctggagctttttcacctttgggtccaccttctgaagaagggggattccgaatgccgccgtcttgccggtaccggtctgggcctggccaatcatgtcacggccctccatggctaccgggatggcctgggcctggataggtgaagcctcctcaaatcccatttccgtaatagcacggataattctttcgtctaattgtaactcgtcaaacttaactgtctccatataactgattatgtcctttcttcctctgcctctttccctcatggaaagcagacaggccgccttgtgcatttcccccacattaccgccagaaccatatctcccggtgtggcgccgtataaccttatacagccccatacccgcacccctgctcaggaaatatgacatgtgatgcaccgcaatattaagagcgtttcttcacgaaacgaacatccttttcacacaaaaaacgagaggtaatacaggcacgtcgcggcctttcatcctctcgcttcctacgatagttaactataacagatattggtgcggctgtcaatgtttttacttatttttttcctgatgccgtacatagcctgtatatatccatcatctgtgttttacctattttgacaaaattacccaccggaatggtatccccataggtggccttgtccgccatctcctcaaacgcatccaccggcagtcccgcatcctcaaatctaagcggcatgcccagtttgcagaaaaatcccctcatccttctgattccctccatacagatggcatcctcttccccataagccaggtccacatcccatacgcgcaccgcaaactgcatgaagcgttttttgtcatgactgtatacatattccatccatgccggatacacaatggacaggctggctccatgggcaatgtcatattttccgctcatctcaagggcaatcctgtgggaagcccagtcctggacgcggccagtgttaagaagcccgttgtgcgccagcgtcccggcccagacaatctctgcccttgcatcgtaatcctcaggttcctcaagcgtctttaccccattggcaatgatgcttctcaaggcaccctcacaaagcctgtcggtcagatccacatgggtggtgttggtaaaataccgctccatgatatgggtcatcatgtccaccacaccgcatccaatctgatagggcgggaggctgtatgtcagttccggattgatgatggagaatacaggccggattaaatccaggttaatgctctttttataccagccatcctcattggtgatgacggaacttaagctggcctcgcttccggctgccggaatggtgcagacagcggctgtcatcagcgtttccttcggagtctccttccccagatagaagtcccatacatcgccgtcatagggaacacctaccccaatggccttggctgtgtcaatggcgcttccgccgccaacggccaggatgaaccgtatgttttctttcctgcacagttcaatcccttcccggaccagtcccagccttggattaggtttcacaccacccagttccagtacctggatgtcctgggccttcaaggatccgcacaccgtgtcaaacaggccgttcctttttatacggtccgagccatagaccagaagagccttatcacagtcactgtatttccttaccttttctcctgtctggttctccgtgcctttaccgaacacaatttccgttgtattggaaaattcaaaattaatcatctgccgtcttctcctatctgtataatcctgcttttccaagagagccgaacagctccattttctcacgtatcacctgtttcgcatcctcgatgccgggattcagcaccttagctggaatgaatcctccggtttcctcaatcacctggttcacctttttgaaaaatgcatatttgaaatcactggaaatgttcaccttacggattccaatcctgcacgcttcccgtatctcctcatccgggttgttgcttcctccatggaggaccagtggcacaggggacactgcctgaatcttctccagcagttccagctggagtttcggcacaaacccttttgggtaaatgccatgggctgttccgatggcaatggccaggcagtcaacgcccgtcttagtcacaaaatccaccacatcctcaggattggtataggtcacatgttccaccccgccttcttcggaattgctcatgacgccgatggttccaatctccccttccaccgatacatccaccatgtgggccagacccgccatttcctttgtcagcattacattctcctcatagggaagttcggagccatccagcattaccgatgtaaaacctgcctggattgctttcatgcactgctccacgcttttgccatggtccagatgaagcacgaaggggaccctgcttcctgccaggcgctcccttacatatgtatagaattccttggtggcaaactcaaattcccccggcgccacctgcacaatggcaggggcatcctgggcttccgcttcctctaccacggaacggaacagggaactttccgtggcgttaaaggcgcctacggcgaagtggttcttattggctactgccagcatttctttcatatttatcagcatttacgtcatcctccattttcctgttgtttctgtttaaaatgtttctatcttaatatcatcgctgttactgcttacgtctgtctcccccgcacttcccaggtcttcaaagctctcatcctcttctgtcaccggcttcttaatcagggaaaggatgacccctgttatcacacttccgattgccagggcaatgcagaattttaccggattggtaaacagcggcacggaaagcatcccgccatgtggaacaggtgcaccgcaggcccagaccatggacagcccgcctgctactgcggaaccgcatacgcaggagaataccacgcggataaggtccctggccgcgatgggaatcacgccctcggtaatcatgcagaaccccatgggaaccgctgcctttaacgcctctttctctgccctggtgtatttattcctggtcagaagacaggatatggcaatgccaaagggaggaatcatggagcctacgaatttaactgcctccggttccaggataccgtcaatcataaggccatttacaaaggttgacatggtcttgttaacaggtccgccgaaatcaaagcaggccatgccgcctaacactgcgccgaatacaaacttagaaccgctctgcaggctgctgattgcctcggtcagtgtcacctgaagccatgcaaatggctgtcctaccacggtaaacataaggactgaggcaacggctgttacaagaacagggatgaccatcaccggcatgagtccctgcattgcctttggaagcttcacatacttcttaaccgccagcacaagatatccgaccaggaaaccggcgacaataccgccgataaagccagccttgatttccgtacagataaatccaaggatcagtccgggcgcaatgcctggacggtcggcaattgaataggcaacacctgcggtaatgaccggcaccacggctgacataccaaagccgcctgccttgtaaaggtaatatccgattcctgatgtggaattgcgcacatcgctgtcaatgaactgccccagtgccatgcaaaggccggctgcaaccaccaacggaatcatgtaaccgattgctgtcaacacatgctttttaatcaatgctataacgccatgttctttcatactttcatcctctcctttatcctttgttttccaatgctttttctaccttctcaataaaaccgattgcatttttaatcactgctgcagtacctacacggataactggtttccccttaaaccgctcttccccggatatcttcacatccactgccaggattaccacgtccgcatccgctatatcctgttctgtcagcttatactccgtacctatggttccctgtgtctcacatctgcactcatgccccctggccctggcgcctttgattaatttctccctggccatataggtatgggcaattcccgcggtacaagcggccacaccgacaatcttcattctatttccccctttctgttaaacagtgtgaatatctcatcctcactctctgttgttaatagtgtttctattacctcatcgtcacatagtgcaactgccacctgggacaataatgaaaccagctctgatttgtccgcactgttgaccgcgaacatgacaaatgccctggacgttccttccccaagggtctcccaatccaccccccggtccacccttccaactgccatggctgtctttatcactgcatctgatttaccgtggggaatggctacctgattgccgattcctgtaggtccttcgctttcccgctcatagaccgcctgtatgaacatctgtctggatgccagtaccccggccttatcaaacatacctgccatttcctcaatgatttcctttttattcctgcccttcatgtgcaggttgatgcaggaacgttgtattacattttctattgccatagatgaaaccatcttacccatcctctccttttcttcaattttctttaagcttcttcccggtccaccgcatcccttaccctctgattcatgagtactgccagctgatggctgtcatccatgcgccggattgcctctacttcctcctcattatcaaacaggtccaggaacacgctgtaaaatttaatcgtttcttctttcatccccgctgcctcgtccagattgaatgccagcaggaataccacatccgcggtttcgtcctcctgccacctgaccggacggttaaggacagccaccgcaacagttggccgtatgacaaactttgcatatccgtggggaattgccaccccttttcctaatgcagtgggtgccgttacctcatgctccagtacggaacgctcaaactccgctgttacatatcctgcgtctgtcaactgtttgcagaggattccaatcagcttatctttatctgatacttccatatgaagatgcacaaactcttcataaaacaggtttctctggatactaagctggttacagggctgcttcagcttaagcttcctccgccttacctgtttcatctttatttccacattcctgatatcatactgggtcatcagatggtctaccaccactacttcctttccaaaataaggacttttcagctgaagggtggtgatgatcaggtcacagggcacgcggtttactttctttaagtccctggcggaaagcacatccacaatccgtatatcactgattgtccgttccagctgctcccgcagaagctgtgatataccaatcccataatcacagaccacacaggctgtcacggttgacaggctccgctcaatggccccgcctaaaagcaatgccaggctgcacatttcatgttcatttaattccagccccagttctttttcaaaataaacgccaaccgcataaatagctgcaaatatattgggatatttctgttttacctgctttaaaagaggatttactgtctttaccccgtaccggagcctggcaatcatggatctgagctgaaggaacaggctcccggaaaagaaaatgtcctgtcttaagtttacatttacaatatcgcttaccagggataccagccgtatggtaaaataacacagttccatatggtctgcctggcatgccagcatctggtccatatcctggaaattctgtatatcagagatatcgatgacaaattccatgaattcctgttcgcacggttccagctttatctgataactttgctcaaggatttcaatgagccgtcccttaatccgccttgaaaaagctccggataccttgcagggaagggcttttggcatggttacaaacttatgcttccttgccctggcaatgctgagggacagcatgaagaacatctggatatgtgcctcatagccaaaagaaaaaccgtaatgctcttccagcgaatagattcccttattgatgccgcttgtgtcaaatcctttcagaaaatcctctataagcagatactcccctgactgcccggccccctgtcccagaccaaacagttccttcctgcttctgcgtttcatcgtcaggaacaggttccacatggccatacgccactggtattcaccataccttatctgataccccttcccccttttcttttccagtataatgccgtaaccgcaaaaccagtcctgcagttttggcatcagccgttccaccaaagagcgccctgcataaaattccttctgtatctcccccagtcccaggctccccctggtcaaaagggaatatatgatctggcttttcagatccagctgtcccattacaggattttcttcatccaaaaggcgtttcagcttttcccagttttcatcatccaccagaagacggacgccttcatggggctttttatccagcttccccagtttttcctgctccattgtttcctgtatcgcaatcagttcattgcgtattgtctttacagatacctgaatcacaccggagatgtcggaaacaggcacatatccgtcctggtcatgaagataatataagatatccatctgtctgctggtcacatacaccttctcctttctcccatggtccttctgttctatatccacattatagcagtctggcatttttgctccgttcatctttttgacacattcctttctgaaaattctgtttttttgacacatttcataatggaagtatcatagcgtaatccatctggatgtacaatgtgagggggaatgaaaacaggcatacgccaatcatcccagcgtatgcctgttccatatcccaatattcagttgagttttttcccggcagcgtctattctctccaatcccatgtttacagcaattcccgccgcaatcatcagccctcctgcaaatgatgcatccaccctgccctttcctgccgccacatccaggaggacgccggtaaatatctgccccacgaatgtaagcatggtaagccggaaagccggaagcctgggaaccgtaaggttacacagcataaccacaatgacgcccatcatgccgcccgtataaataaaggggtgggcggccagcccgctgccggataccggcttcatgatttccccggccagcacacagatgaccactgtaacgggaagtcctgccatatgattaaccagtgaccctgaaagcgcgcccactttcccggacagccgtgcattgacagtccttgacaggactaccgtgacccctgcggccagggacagcaggaccgcatatgaggctttgccaaccgtggcatccagcatgacaaaaatccctgtcagggaaaatgccagccccaccaggttatatctgcaaaacggacaccgcttcatcccaaacagcccaaggcagtcaatcaccagggacatgagggcctgccctaaaagccccaacgccactatgctggtcatgcttatatggccaaaggccagattgttaaacacagtggtaaatgcgcctatggcaccgcccagataaatccaggcaggagcgtgtcctgtcagtttcctgttttccttcctcacagcacacagcaggtatgcaaagaggatacccaccacatggatgatgacggatgcccggaatacgccgtatgatcctgacaggattccattaaccgaaaccatgacggatagtaccaaaccggtcaaaagagccagcagtccatacatccttccacctcccttaagattcatgcactgattataaccgcattcccccaacagggcataggacatttgtcctactgttttgtggcattacctgttataatggaggcagaggtgatattgagatgaaagaactgcccatgtcagataaacacagggaaaaactatcggaatacggccttcaggatatgtaccctgactcctgcaggcttgtgtcttataaggccggggaaacccttctccgggaggggatgccccttacctggcttggcgtcatcatgtgcggcaaagccaaaatatgctctactgcccccaacggcaggaacctggtcctctgctactatgtatcggagggcatcattggcgacctggaacttatgaccggcctgaagggcgcaaccaccaccattgtggcaatcacggattttgaatgtatcactatctccctcagtatacacagtgcggcccttaaatccaataccgtattcttgaacagggtgggaaatgaactggccttaaagctgctgcgaagctcagccaattttgtgtcctcctccctgtactccggcgaggaacggctctgctcctacatcctgcagacatcccacaaccgcatgttcagtgatatcctgtccgatgtctcctgttccgtgggaatgagttaccgccatatgttccggctgttaaaccagctctgcgcggaagggatactggagaaacacggatatggctatcttatcctggacctggatgccttaatccggcgttcagagtcctcacaccacaaaacagtctgatgacaggtatgcaagacggcacgccaaaggggcatggaatccatgccccttcatcctatcccaaccgatactggttaaaattgtactacatcctttatctcttccgcccgctccacgttctctgcatacagtacaggaccttcaccgtggtaatccttctggtattcaatccccactttggcccgtaccttaacccactgcttggtcttatactcttctgcgccttcccatttgcacataaagccaaggaaggtcatatctgcttcacagcaggtcatggccatacggccgggcacgaactgtcccttggggaatttaggggactttaacaccatggcggtaaattccaccactttgtccttgtaccgttccggctggtccatacagtcaatataccagatgccgtaatctttcggcttaatctcaatcacatccgcgttcaggtcatagggaagatcctcctccagggtggcctgctcaatctcaccgtccttatcttccagcacgatctcgctgtcccggctcatggcccggatggtacggcggtaggctgtcagcttctcatccgggatgccgtcgcaccggttcatgatgataagctcagacccgcgcagcatggcgcctaaaaggggcttcatattctgcacgtaaaggtcaaaggtggagccgtcaatgatggtaatctgctggtatatggtccagtcatcaggcagcttaagttcatcctggttccacatgccgttccattccataaggacacgttccggacggtataccacttccagctcattcagatactggggtgtcagcttctcaaatgaatccacatataccacagctgtcctgttctttttaagctttttctcatcatattccgtatccccttcctcacacacaataagaagggtcttgccgtctgccttaaaataatcctgctgcatggtaaagtccaggaactgggtcttacctgcctcaaggaagccgttgattaaaaacaacggcatgatatcgtcttcaatttcatatgccataatattatcctcagcttcttccgaatacgctgtttaacgcttcttcttcaaggcttgcaccaatcacgcacaccttgccggtataatcaggccttccctcgcggatttcatactgctcgggcactaagtcaaagtacagccactcccctggattctccgtgggcagcatccccttcgccctcagtacctgtccaaattcctccgtgtaagccagacgtttcagtatatcctccagctggtcatgggttaccggaacaattgtctccatgccccagcttgtgaatacctcatccgcatgatggtgtccgtggtcatggccgcagcatccatggtcgtggtgatggtggtcatggcattcttccccgtcatgatggtgatgttcatggccttcctctccatcatggtgatgctcatgacactcttccccgtcatggtgatgatgcccatggcactcttccccatcatgatgatgttcatggcactcttccccgtcatggtgatgatgctcatggcactcttccccatcatggtgatgatgcccatgacactcttccccgtcatggtgatgatgcccatggcactcttccccgtcatggtgatgatgctcatggcactcttccccatcatggtgatgatgctcatggcacccttccccttcatgatggtgctcatggcattcttcctcatgatgctgacggctttccctcacctctgccagaaggtcatccagcatggtatcatgcttctcaatgatttcaagcagctgcgccccggacagctccgccaggggtgttgttatgatggctgcgtcgcggttcttctcacgaagcatgtccacatccttctgcacctttgcagcatctgttatatcggtacggctgagcacaatggtgcctgcattttcaatctggttgttaaaaaactcgccgaaattcttcatatacatcttgcactttgcagcatccacaatggttacggcgctgttcagttccacttccatgtccgcagatacgtccaccactgccttcaccacgtctgacagcttgccaacgcctgagggttcaatgatgatgcgctccggtttatactttgtgatgacttctgccagggatgcgccaaaatcgcctaccaatgaacagcagatacagcctgagttcatctcacggatttctattccggcatcctttaagaagcctccgtcaattccaatctcgccaaattcgttttcaatcagtacgacctgttctccggcaatcgcctcttccaaaagctttttgatgaacgttgtcttccccgcaccaagaaaaccggaaataatatcaattttcgtcattttactctttccttctttctgaatatccgactccctgcgccgtcttgccgcaacagggcattattataacctgtcaattgactattttggcacatcagccacataaagtcaagacgtaggcgcttttatcttttaccggcagcactggctaatcattttaaaaccatggataagccattccttcacacacggacagggcagacaaagcttatccaaagcttcatctgccctgccccattgcacagtgattcacctacaaatcaaactaatatcacaaccttacagttttctccccgtccccatcagaaatccagatacatatgcattggataggaaaggtattccacgtcatccagcttctccaccgtgatatatccggccggtgcattgaggatggtcgggatacggttaacgatggtcgcacatgtatgctccacggtagccggtttcctgacaaagaaggtggtatccggttcacctatgatcttccagtcgcataaatcgccgtcatccggtccataaaccttgccgatacactgggtttcaatcaccggtccctgaaaagtctcggtggtcaccaccgcgctcatgccgatgcagttgcccttgggaatcgtatatcccatggtctcggaatacaggtccgaatcatagaaatatggaacacacttctgtgtctgggacttgatggtccagcccatcttattgcacagggcctcattggagttccacacatagcatggctccagtgtctcaggatgggcaatctttgcctcaaattcctccggcgtaagcccgaccccatgggcctctgccagggccagtccgtagtcctccacattgtagctggtggctccctcaatccggtcaatgcggtgtacgcctcccgccacacagccaatcatgtttacccagtaaatatcctgcatgcctgcgcccacgatggtgcagttattatccttagccagcttatccagcttattggtgatggcgcttgccgtggtccacggatagattgcctcctcgcaggtggttaccacattaatccccctggacacgcacttctcaaaatggggatacacgtcctccatgaagctgaacagggtcaccactgcaatatctgcgtcgcattcatctaaaacagcatctgcgtcatcgcggattgtcacgccaatcttaaatcccaggcccgcgaactctcccacgtccattccgaccacggcaggattcacatcaatcgcacctacaatctcagcacctttctcatacagatagcgcaggatatatttgcccatctttccacagccatactgtaccacacggattttttcgcaattcatcatgattcttaacccctttcctgtatcgttgctttgtacattgatagttcctgatataagtataaggcttatacaaggtatggagtcaagggctttttttatgcatttccccgcagggagacaggtatctggagccggaggaacatgcccctttcctgcatgtccatgggcacctccgccaccacctcacagatataatcgccggtaatcctgtagtgtttttcctggatttccttcagaaggcggccgatatattccttctccttatcaaaactgttacagtaaatacacaggtaggtactggccggtatgggggtaatcaggctttccttcacaaaccccttatccaccagcacgaatatctgtgtggaacagaactccccttttatcagggactccttcttcatgacggttcccgcattatagaaatatatgggggacagctggttggcaatcaggttcttcttcaaatcacgcaggatctgctcatacacgtcaatcccgtaatcatagaaattcacacctgaatccgtcatataagtcaggcgccccgggatgtactccagcacaatggcgccgtccggaggggcattttcataccattcatagctttccagggtgcgctcaatggcctttctctggtacatcagttccctggacctgtcatcaatctcatccaggttgcggtacaggatatccttgagcatgtccgggtcaaagtgctttagctgtttcttgatatccttaagcgacatccccagggccttcatgcgctggatcatatccagctgcgcgctttggcgtatatcataataacggtatccattctccgcatcccggtgcaggggtgagaacaatccctccttatcataaagacgcagcgcctgttccgacacaccgttcagccttgccatctgtccaattgacagttttttcacagcacacccctcccgaatattatgtattttatataatcacgcgcctgtatctgctctgaatatggaataattataccaaaaaaaccttataccagcaataaggttttgcccctcctatttcatttactgtagattatttatcaattgtatctcccttaaaatggaaattttcacaaaacgcttatcatagtatgtttatcacagtacgcttatcacagcacttccctccaaaaaataatacctgcggcccaccccgccggtcccgccaccttaagggggcgtcccggtccggcgtgtgccgcaggcatttccgctcatattaattccgctcatattgtttctttttgccaggaatggaaaacctttaccatctcctcgctgcttagctcagcttcttcacaatcttctccgcatcctcctggttgccgattaccatcaggtggatatcgctctctacgacataatccgcgcctggcatgaatttcatatgcccacccttatttttaagggcaatgatggaaatgccgtatacccggcggatattcaggtccttgatggacttccctacccaggaatccaggggacggatctcaaaaatggaaatgccgtcagccagctccgtatagtcaaacacattgttgccgctgtagcgcaccgctgccttctctgccacgtcccggtccggatagaccacctggtccgccccgttctttaacagaagacgcgcatggatgttgcggttggccttgctgacaacgtacttggcccccatctccttaatcatgctggtaacctccaggctgttctggaagttattgccaatgcagatgaagcagatatcaaaattccccaccccaaggctttttaatacagcctcattggtgcagtcgccaatcttggcgctgaccacatagggaaggataggctccagcttttcttccgatatatccactgccatgatctgattgtcatgctttgccagattctcacacaggtgctgtccaaaccttccgattccgattacaagaattgatttcatgtataagatacccctctcttttttcttagacccttttatccaatggtaatcctctcagccggcagctgcacatgaggcttgcggctggacctggtgaatgcaagcgcaaaggacaggctgccgatacgtccgcagtacatcaggataatgattacaatcctcgaaagcggattcaggcttctggtcacgcccgtactcatgccggatgtgccgatggccgaacacgtctcaaaaaacacatctgacataggcaggttctggaacaccatgatcaggatggttgccgtgagcatcaggctcaggttgatggtcaggatacaggctgactggcggatggattcatcctgaagcctcctgccgaatatctccacgccataggtctggcggatattggaatggacatacagaagcagcacggccagcgtggtggtcttgatgcctcctgccgtggagccggggctgccgccaatgaacatcagcatggccgacaggaacttgctcccgtctgtcagggccgccgtgtccacattgttgaatccggctgtccttggcgtcaccgcgctgaaaaagcaggctaggaacttctgcgaaccgttcatccccaccaggatgttgtcccgctccatcagataaaacaggatggtcccacctgccagcagcactgccgtggtgaccagcactatcttggtgtggagcaggtaatggcggacatcccaccgtttcctgtacaggtcgtcccacacaatgaatccgataccgccgatgattatcagggtggaaatggtcccaatcaccacccagtcccctgcataggagcacagggagctgtactgctccgtatgtcccatcagatcaaatcctgcattacagaacgcggatatggaatggaatatgccataccaggtgccgcggaacagtccgtactgcggaatgaaacggagggacaatatgatggcgcccgccccctcaaaaatcgcagttcctatgatgatccgttttgccagcttcaccatgccgccaatctgcagcgtgttgacgctctcttccataagtccccgttcctttaacccgattttgcgcctcagcacaatggagaggaatataccgatactgatgaagcccagcccgcccagctggatcatgatcagcaaaagcgcctgtccaaacaggctccactgggtccaggtgtccgccaccaccagcccggtcacgcaggtggcgctggtagccgtaaacaggcagttgaggaacggctcgccctgtccgtccctgctggataccggcagcatcagcagcagggttcctgtcatgattatcaggaagaatccatatgcaatgaattgtgtctgtgatatatgtttttttaaatgcttctgtttaaaatcatacagcttctctttcatgttcccctcacttaacccttttgcggaatatggcacagattgacatcccaaatcccaggggcatttttatggaaatccttcccacgaactgcattgtatcacttgtttcacggtatgtctacctgcaaatggccggtccggctaaattcccggaaatgtccggctgaatcgtgcagtccaatcctcctgcctcacgtccggagccgccctaaggactgccatgccatgaacaggatgaacaccaggaggtttaccaccaccacgctggccccggccggcgttgagaactgataggaggccgtcattcctattataaagcataggacggacaatatacccgcggacaccacaacactgccaaagcttttaaacacccgcatggaggaaaggcatgggaagataatcaggctggaaatcagcatggcgcccatcatgcgcatgcccagcacgatggtcactgccgtgagcacggcaatcaccacattatagaagcccacattgaccccggttgcctttgcaaaattctcgtcaaatgtaactgcgaatatcttattgtagcacaccaggaacaggataagcaccaccaccgacagcacggcggacagcgccacatcctcacggctcatggccaggatgctgccgaacatataactgctcacatccgtggtcagccccgtggtcagggaggtgactatgatgccgatggccagtgcgctggcagatatcagcgcaatggccgcatcgctttttatcctgctgttctccgtaatcctcagcaggaaaaatgccgccaggaccaccaccgggatggataccttcagcggggaccagcccatggccagggcaacggataacgctccgaaggatacatgggaaagcccgtccccaatcatggaataccgttttaacaccaggcttacccccaggagcgaggcgcacagggataccagcatcccgcccacaagcgcccttacaaggaaggggtatgataacatttcgccgatgatattcattgtctctcctccttcttctcagccggatgtacgtggagctttggcacatggcagcctgccgtgggcttgcaccggccctgttccttctcatggaagaaatggcctgccgccttgctgttcatatagtcatgggcaggtccgtagaacatgacccgcttctgtaaatgaaggattttgttggcctcctccaccgcattcctcaaatcatgggaaaccatcaggatggccaccccgtcttcccggttcaggcgccggagcatggcatagaattcctggattgccatcggatccaggcctgtaatgggttcatccaggatcagcagctgtgtggtggcacacaaggccctggcaatcagcaccctctgctgctgtccacctgacagttcacggtagcataaatccttaaggggggtgatgcccagcttctccatgttcgttcctgcaatctccttttcaaccctggaataaaagggtttccacccccgcctgctgaggcatccgcttaacactacctccagcaccgtggccggaaaatccttctgggcagccgtctgctggggcaggtatccgattcccgaacccttcagctcatcggataccgtcagcctccctgccgtgggctttaaaaggccaagaaggcccttcatgagcgtactcttgcctgaaccattttccccaacgatacacaggtaatcgccagggttgacctccatgtccacatccaccaccgcgtcctggttatcgtatccaaaatcaacatgttcacatttaattaaaggtgtcatctcatacctcatctttttcattgctgccaatactactcaaggcccttcctaaggttctccacattctggttcatcagctgaaggtaggtaaccccttcgtcaaactgtttccttgtcacattatggcaggaatggagaaggagcggaaccgccccggtctcctcgctgatgatttccgccgtgcggtggctggacagctccaggtaatacaccccgtggatctgttcctccttcaccttgtcaatcaggtaggcgatggttttggcgcttggctccgtatccgtgctgcagccggaaaatgcggccctgtaggaaagcccgtactcgtccgcaaagtaccggaacgggaacttgtccgcaaccacgatcatatggttccttccctgcgccaccacctgcctgaaccgtccgtccaggtccttcagctcctcaatgtaggcatccgcattggccttgaaccggccgctgtcctctggggcggcttccatcagggtctggctgatgatccttacaatggcctgggcgttcacaggtgaggtccagatatgctcatcatattcaatatccatctcatgcccgtccctgtcatcgtatgcatgcagttccggcacgccttcatggtccccgtaagcactagtgtcttccatgtatccatggccgtcttccatgtgtccgtgggcgtcttcaccaggttcatgggcatttcccccatgtacgtgggcgtcttccccatgctcatgggcatcctccatgccctccacatgctcctcctccaccgcgtccacgtaatccatcatggtgagtatcttcatatggctggtatccagtgaatccagcacctgtccgacccagtgttccatctccccgccgttgagcaccagcacgtccgcctcctgcatggcaatcatgtccgcaggcgtgggctcaaaggaatggctgtccatcccggccgggacaatcagcttcagcttcaccctgtcccctgcaatctggcgcacaaaatcataataggggaaaatcgtggtgacaacgcacagacggtcatccgccccatcccggacctcacccccatggctgccgcccccaggccctgtccccggcctggcgccgcacccccacgcgccaaggatggtcccggctgtcacaagcagcgccatcagccaggccatcctttttagtttcgtattcttttccctattcaattccattcacatcctttatataccgcaccacatccacgggatggtccgctatcagttccgggttaaatgcctccagctcttccctgtccctgaagccccatgtgacgcccaccgtatccacctgggcgttcttaccagtgcgcatgtccgtattggtgtcccccagatacagcacctcttcccggtccacccccagttcctccatcagcgcccacacgccgtccggggacggttttttcctgattcccttgtcctcgcgctccccatagaccaggtcgaacctgccctttccgaatacgccctccacattgtccagggtccttggatggggcttgttggacaacaccgctgtttttatatggttctccttcaggaaatccagcagttccatgattccgtcatacgcctttacacggtacatacagcaccctttgaaaatctccggatacagattcactgcctccccgtaatgttcaagcttactgtccccgcaggcctccagggcgcgctccagcagcttcttatatccatcgcccacgaaaacacggcactcatccactgaaacctgcctcatcccccacttctccagggacaggttcacagacctctggattgcatatatggaattaacaagtgtcccgtccaaatcaaaaatacagcatttatacattatggtttccatccctttccattcatatactccggttttcaacacaaagtacatcatagcacaattccctctgtttgaccagtaccacccatatacaggtctgcccgcgggcatgcatttgacacccatccgtccccatgctatacttttcccataacaaacacaccagcagtttacaaatttaaaggagcacattatgagtaacccttatgtaataacctgttgttccactgcagacatgcccaagcactacctggcagaacggggaatcccttatgcctgcttccatttcaggatggaagataaagaatatgatgatgatttaggcaaatccatttcacttgaggaattttatcaaaaaatccgtgacggcgccatgcccaccacgtcccaggtgaatcccgaacagtatgaggccatgtttgagccaatattaaaagaaggaaaggatatcatccacctgaccctgtccaccggtatatccggaacctataattctgctgtcattgccagggacgagatgttggagcgctatcctgaacgccgcatcgagataatcgactccctgacagcttccgtgggatacggtcttttgctggatacggcctgggagaggatgcaggccggagcggattatgaagaactggtttcctggatcaaagaacataagttacagctgcacggatggttcttcacaaccgacttaagccacctgaggagaggcggcaggatatcggcctccgcggcctttttcggcaacatgctgaacatatgtccgctgatgaatatcaatcatgagggaaaactgattccccgggacaaattccggggcaggaagaaggtaataagagaactggccgaacggatgaagctccatgccttggacggcaccggatattccggcagatgttttatctgccactcctcctgccccgaggacgccgcggccgtggcatccctgattgaggagaactttcccaatctggaccagaagccgttcctggcggaaataggaaccgtaatcggctcccacacaggtcccggcacagtaggtatattcttctggggcgataagaggacggattaagtcttacccttccttcccggccatgacatacagggccgcgaatcccagggctgcggcaatcacgccgtacacaatatcaatgccctggggtatgcctggaaacagttcgggaagggaaccgaacataaagcccaggatgatgaggtaggtgggctggggatggcgctgcatcagcccttccagcaccttggccgtaaggaatatgccgcccagcacgcctgcgccaagtggaatcaggggcaggatgttcagggtgcttatgttctttatgatgccctcatagattcccagcatatataacatctgggacacgctgattcccggaagcaccaggcccaccgcgatgatcacgccgcctgcaagctggatcaggacagcgccggggccaaagcttccgtccggtgcaaacagcccggccgggagcagggccaggatgaccaccccaaggattcctataataggataggcaaccgctccaaggctgatcctcctgataccggcctccctgtatatcatgggcacgcccccggccactgcccccaggaagaagaagcggaggggtacatctgccctggtggtgaacaggaagcttatgaacctggaaaacagcaccatacccactcccgcccccaggacgaaacgcaccaggaaggacatgctctttcccggattcctgaaaaatgaactgaccgaggaaatcagccggtcatagacccccagtatcattgccatagaaccgccgctgacgcccggcacggtcatggtgccgccaatccacattccttttaatatcgtaatcagattatccctatccattctcaagctcctttttccgttatctggtccattgtaccctattgaatacaaaatgggaattaattttctgtatatattatgcctgaaaatgccctcttattgctgcttttccaaactgtctgcgccgcagaccgcaaaaagccccggaacatataggttccagggtgtgtttgaaaattgctttccgtcagctgtgcgtcccacttcgtgggagatttggtcccgatgagggaggcgtagcgagctacgttgaccgaattgggaccaaatataccgcgaagtggggcgtgcagatggcgggaatgaattttcaaacacaccctggggctttttcagggaatatgattatataggaatgatggttatgtacggatggtcctgtttagaatcccattccgtaggaaaatccgttgctgcaggacccggtgctgcagccgctgccctggcaagtactgcctgtgcagttaccgcccgcacagcctggattcaggccgcactgtgaaccgcctgcgcttacgcccatacggcttaagatggcatccagctcctgtccgccgttctgatagcagacagcctgggggcagttggcggtgtcatagagcgctgcgttgtactgattcatatttgccatattggtgccgcatacattgcccaacagggctgctgcggccatggttgaaactggtaacatagttttgtcctcactttcccattttaaaatgttacaaatgtatttcttttttgttacaaaactatattaccacaattaggattccttgtgtcagggagtaattgggggatttcccagaatatgggagacaagattcgatttatttttagttatatttgtcccactgcgtgaatatatttttactattatgtaaccgaccctgtatcaaggcaggctgcaggcggttactattatatgacaggggattttacattatgctaaataacgtcaagaaaaacgtaagtacatcatttccatttctcaggtccgaccgccactttgcccatacgcaggaaatattcgataccgtccagaccatgaacataagccagacactgaatttttccatcctgctcatcctcatggagctgggcaacctgatcagctactgggccgtggacataagaagccgtcttatctcccccaccagcttcgccatactcatattcctcctgtacatgggctttaatatattttactgtgattatctgctgggactggagcgcaatgggcggaccaggaagctgctccagtgccacacctattcctttaccatcatgttcagcctgttctgtctctgcatgaactacctctgcctgaagggcaggatgagtgcggaaagcgtgctcctgttctatatttacctggcggcaggccctatctatacgtacaaggaagccctggcagccattgtcaccaccggtgcgctggcccttccttcttttgttgcccagaaagcgcctgtatccatgtactccaacatgttcctgtacagcttcaccagcctgttcctgtcacagatgcgctgccgcatcacaggaaacaacctgaggcttttaagggaagcctgggacgaacaggtatatctccaggaccgggctgacaacgaccccctgacccaggtccttaaccgcagcggtttttccgtgcggctggaacagctgattcccgctgccatccagctctatgtgcccatcgccgtcatcatggtggacatcgactatttcaagcagtacaacgacaccttcggccatatggccggggatgaatgcctgaaaaaggtggctgctgccctggcttcccgcatccaccagggcagggatttaatctgccgtttcggcggggaggaattccagatccttctgtatgggattaagcccgaggacgccctccacgctgccgaccgcctccgccaggctgtggccgacctgaagctgcccgccgccgacagacgcacggctccctatgtcaccatcagcgtaggtgtctccagcgcggtcccttcctccatggagacatataacggcatgataaaggcagccgacgatgaactgtattacgccaagaatcacggcaagaacatggtgtccttccgggaactgccgcccgaaaaggaatccgtcccaagttccgtatccgtaacccggtgcatggccgtatcatgtgagctgcccaaatcatgatattatttcacaaaaatgctctccgcatagttgacggaagccattgcgtcccggcagtacatgtccgcatcaatggtcctggcatattcttccgtaaggaccgcccctccgaccatgaccctggcccatggcgcggctgtcctcagcctgcggatggtctcctccatgcttgggaccgtggtggtcatcagggcgctgagtcccacaagctgaaccttcctgcccatggtttcctccactatccgctccggaggcacgtccttgcccaggtccaccacctcatatccgtagttctctaacagtaccttcactatattcttgccaatgtcatggatatcgccttttaccgttgcaagtacgatggttccctttttctcctgtacctggcccttggcgtccatctttgtcttgatgacctcaaaggctgcttttgccgcttccgcgctcatgagaagctgcgggaggaagatggttcccttctcaaatccctttcccacccggtccagggccggaatcatctggtcattgatgattgccaggggttccttttcctccaaaagcgcggtgaccgcctgatgggccgcatccttcagcccccgctcaatggccgcggacagggagcagtccgtgctttcccctgctgcggcagtcccgccttttcctatggtctgtcccagaccggcggactggccgctgtatacaccgatgtactggctgcactgggcatccctgtccataagggcattgaagctgtagaatgcccgcatcatggcttccgaattaggattgatgatggctgcgtttaagcccgcctccatggccatggtaaagaatgcggcgttgatgatttcccgttgaggcagtccgaaggaaatgttggaaactcccaggatggatctgcctcccagttcatcccggatgcggcggagcgtgtccagggtggtcagggcgcctttgctgtctgaacttaccgtcatacagaggccgtccagtatgatatcctcggccccgatgccataggacgcggccgtgtctataatcttgcgccccacttcaatccgtcctccggctgtctccgggatcccgccttcatccaggcacaggcccaccaccacgccgccgtactttgccaccagcgggaatacctggtgcatgacctcttccttgccattgaccgaattaatcaggggctttccattatatacccgcatggcccgctccatggcttccatatccgacgtgtcaatctgaagcggcaggtctatgatgctctgaagctccttcaccacttcctccatcatggatggttcgtcaatccccggcaggcccacgttcacatccagcacatccgcgccattatcctgctggcttacgccctccctcaggatgtattccaggtcatggtccctcagggcctgtttgaacttggatttacccgtgggattgatgcgttccccgatgattacggttttcccgccgattaccactgcctgtgcataggaagaaatgacggtgcgcttcttaggctctggcaggcggacaggaatatccctgcagcgtttaacggtttcccgtatgtgcgccggggtggtaccgcagcatccgcccaccacggcggcccccaattgagcgatttcctccatggcaagggcaaactgcttctcatcaatatcatagaccgtcctgccctcctcgcttcttgggaggcccgcattggggttcaccagcacgggaagggaggtcaccttcatgatgtccctgaggatttccttcatctgcacagggccaaggccgcagttgattcccagggcatccaccctcagtccctccagcagggccacggtggactccacattgcccccggtcagaagttttcccttctcatcgtatatgaccgttgcaaacacaggaaggggttccccatcctcccggcttatgcctgcttcctttgcagccagcacagccgcctttaattcatagctgtcgctcatggtctcaatcaggataaggtcagcgcctgcctttgcacccgcggtgacaacctctttataaaggctgaccgctgcctcaaactccaggtcccccagcggtttcagcagctttcccgtggggcccaggtccagcgccacatatccgtgtcctgcctcctccaccgctgccctggcatggcccactgccgctgccacgatttcctccaggttatccctgtacttcagcccattagccccaaatgtattggtggtcatgatatcggcccctgccgccaggtactgtctgtggatgtccctgagcacctcggggtgtgtcaggttccacagctccggcagttcccctgccttaaggccctgggcctgaagcaggcttcccatgccgccgtcacagaacaggcggcgcactttcatttcctctaatattctcattgtcagtcctcgcaagctaatatatcctgtaccaggatgtccacatgctcctcactggtaatccagctggtgcagaggcgtatggccgtgtggctgtcatccacgcgtccctgatgggtgtagctgaaccttccctcccactgcttaagcaccttgtccggcatgatggggaatacctggttcgtggtattgtataccaggaacgggtatcccttatccgtacaggcctttctgatcctgtccgccagacggtccgcgtgcctgcccagctccatgtacagcccgtcccttagaagttctgagaactggattcccagaaggcgtcctttggccagcattccgcctctctgcttgatatgatagcggaaatctgacttaagctcctggttcaggatgaccaccgcctcgccgaacagggcgcccaccttggtgcctccgatataaaacacatcgcagttggcagccagcaccggaaggtccacgtcattgccctcggccataaggccgtaggccaggcgcgccccgtccacaaacaggtacagcccgtacttcctgcacacaccgtaaagcgcttccagctccgcccttgtgtaaatggtccccagctccgtagggttggatatatacaccatcttgggctgtaccatgtgttcaaagctctcgtcgtggatgtgttccaggtaaagcgtctccacctggccggcgcttatcttgccatcctccgacgcaagggccaggaccttgtgtccggttgcctcaatggaacctgtctcatggacattaatatgggcggacacagcgcccacaacgccctgatggggcctgagggcagatgcaatcaccgtcatgttggcctgggtcccgcccaccaggaagtgcacgtcagcatcttcccgtttacagagtccccggatgatggaggcagcctcctcacaatagtggtcctccccgtatccgggcgtctgttccaggtttgtctccatcagtttcctgaggatgcgctcatgggcgccctcactgtaatcgcagttaaaacgaatcattttctttcctctccttttccctttcatggtacaggtccctaccgcctgtacgcgcagtccttcttcccacatgcctcgcagcccttcacatcacagcggtacggcttcctgctggcgcccatcacggccgtgacagatttggaaggcatcatgagaaggctgtccgtaagcttgatgccgatgcgcttgcctgcctccagacagtctaacagccggctctggcagtccagcgggaaatctccgtagcccggactgaaccttgggcgcagataccagccgtccgcctcgtaatccgccttcaggccggcgcagacctggtcgcagtattcctctatcatggcagtggcagcggcctgcatgataacggccttgctcatctggagacggttatacttcccgatcagatggtccgcccccgtgcccagggtggctgcgaatacaaggatcctgccgcagtccgccaggtttcttgccaggttcctgctccttgtaaggaagaccccggcatccaccaggccgtcctgccccagggccaggggataatcccggcacagatgcaggggcctggcttcccggccaagttccccgatgcactgttccaccagctccatcacccgttcatccgcttcatgccttccatatcccagataccgcagtacttcccccctgtcaatatcccgtgtctccatccaatcctcctatggcgtgcatgtgtactcatttccaagtatttctgaaagattctccttgattttcccggccacatccggcttgttcatggaatagatgtggattccgttgaccccgttggcaatcaggtcgatgatctggtccgttgcataggcaatgccagcctgcttcatggcagccggatgatccccgaaccggtccacgatggacatgaacctggacggcaggtacgtgccggacatctgtgtgatacgcttgatctgtttcgcattggtaaccggcatgatcccggcaatgacagggaccgtgattcccttttcccggatgcggtacagatagctgtacaggatgctgttatcaaaaaacatctgggtggtcacgaaatcgcagccagcctccaccttctgtttcagatagtccatgtccaccgacttgttggcggattccacatggccctccggatagcaggcagcgccgatgcagaaatcccccgactgtttgatttcccgaatcagttcggacgcatagtggtaaaccttgggggtctgtccgttttcagggatatcccccctgagggccagcacattctcaatcccatgtgccttcagctccttaagcaccccctgtaccttctccctggtggacgacacgcaggtcagatgggccaggggcgtcacgccgtactccttgatgtccgaggcaatgcccaccgtataatcgctggtgcctccgcctgcgccgtatgtaacgctcataaatgccggcttaagcttggcaatctcttttgccgccttctccaccgtattatagttatcttctgtcttaggaggaaatacctcaaaagacagggtgggcttcccctgtgccagtatatcccgaatcttcataatcgctctgcctctctttactcaaaatgccccggcccccttttctgattcaggattgccggagcatggatacacagtgcatgtgcgctgctgcatgatacagcagccacgtgcacttactatttacatctcaaccgtcacttttttcaggtgccagatatcccttacatactcctcaatggtcctgtcggatgtaaacttaccgctgtcagccacattgaggatggctgccttggcccaccacttctcatctctgtatgccttatccaccttggcatgggcctctgcataggaacggaaatccttcaggatgaagtaggtatccgccttatcgctgctcttggtattcagcagggagttatagatatcccggaacagctcagggttatccggcgcatagtagccgttaatcagctgcatcagcaccctgcggatttcctggtcattgttaaagatatccattggataatatccgccgttattctcataattaatgacctcatccgatgacatgccgaagatgaaggcatattcgctgcccacttcctcaacaatctccacattggccccgtccatggtgcccagtgtcagggcgccgttgagcatgaacttcatgttgcccgtgcccgaagcctccttgctggccgtggaaatctgctcactcacatcagcagccgcaaagataagctctgcgttgcttaccctgtaatcctcaatgaataccaccttaatcttgcctccgatggacttgtcattgttgattacatccgccacggaattgattaacttgatggtcagcttggcgcgcttataaccggccgctgccttggcgccgaagatgaatgtcctgggcaccatatccatgtccggattatcctttaactggttatacagatacatcacatgcaggatgttcatcagctggcgcttatattcgtgaagcctctttacctgtacgtcaaagatagaacgggggtccacctcaatcccgttgtgttccttgatatatctggccagtcggatcttgttctggtacttgatgttcatgaattcctgctggcacttttcatcgtccgcataaatctccagcttcttgatatggggaaggttggtaatccactcatccccgatcttggaggtcacccagtcagcaagcaggggattgccgtggagcaggaaccttctctgggtaatgccgttggtcttgttgttgaacttctccggcatcatctgatagaaatcctttaactcctggttcttaaggatctcggtgtgcagtctggcaacgccgttgacggaaaagctggctgcaatggccatgtaagccatcttcacctgtccgtcgtagatgatggacatcttgcgcagcttctcctggttgcccggatacatggactggatctggttctggaacctgcggttgatttcctccacaatctggtaaatccttggaagcaggcgtgagaacagctctatgggccatttctccagggcctctgacatgatggtgtggttggtgtacgcacatgtcttggtggtcacctcccatgcctcatcccagttcaggccttcctcatccaaaaggatacgcatcagctcagggattgcaaccgtggggtgggtatcgttcagctgaaacgccaccttctcatggaacctgcggatatcgtcatgtttttccttatactttgtgattgccctctgcacgctggcggagatgaagaaatactgctgtttcaggcgcagttccttgcccgcatagtggttgtcgttgggatacagcacttccacgatggtcttggcaaggttctcctgctccactgccttctggtaatcgccccggtcaaaggaatccaggttaaatgtattcaccggctccgcatcccagatacgcagggtattcaccacgttattgccgtaaccgattaccggcaggtcataaggcacggcgcggaccgtctgatagccgtcctgcacgaaatggttggcgccgttcacattctcaatgcgcacatagccgccgaacttaacttcctgcgcatactccgggcggcggatttcaaatgggttgccgtccttcagccattcatccggcacctcaatctggtagccgttctcaatcttctgtttgaacataccgtagcggtagcggatgccgcagccgtaagcaggatatcccagcgtcgcaagggaatccaggaaacacgcggccagacgtcccagaccgccgttgccaagggcagcgtccggttcctggtcctcaatcaggtttaaatcaaatcccagttcatccagcacttccttaatctcatcatgggcgcatatgttgatgatgttgttgcccagggcgcggcccatcaggaattccatggacaggtagtatactgtctttgtatctttcttttcatactctttgtgggttgctatccactcgtcgatgataacatcctttaccgcataggcaaccgcctggaatacctgctggggcgtagcctcgtcaatggtacggcggaacatgttcttcacgttgtctatcacgctgcgcttgaatgtgactttatcaaatcctttattcatcggcacaatcctccctatcctcatataggcggggttttttaaccccgcctcccatattaacattatttcatggtcttttcaacaccaagcatgactttttcgccgttgatgccccactccttggcgtagccgcccatccttccaaggaagatggtatcagccattacctcggccttgatctggtctgcattggccttcagaagctctgcaatcctgtcattgtcatcctggtaaacagcgatatggtccatgacctcaaaacctgcttccttacgcatggtctggatcttgctgatgatctcgcggacaaagccttcctcaaccagctccggtgtcaggttggtatccagcaccacggtcaggtagttgtcctcttccgtcacatatccgtccttctgtgatacgtcaatcagaaggtcgtcctttgtcagcaccacttcctgccctgcgaagtcaaaggtcagggcgccgctttcattcagcgtatccatggcggcgctgccgtcaatatccgtaagggcctggcggatctgtcccaggagtttcccgtacttgggtcccaccgtcttaagctggggcttaaaggtataggaggtaaattccctcacatcatcggagaaggccaccttcttcacattcagctcatcctcaatgatcttcacatagaactcggacagggcgtggtcagccttgatatacatctgggcaataggctggcggttcttgatgttggcggcattccttgcggcgcggcccatgaccacggcctttaagacttcatccatgtcctgctccaggctggtgtcaatccaggcctcctgcacctcagggaagtcgcacaggtgaacgctttcaggcgcatccgcatcaatcttcctgacaatgttctggtaaatctgctctgtcatgaacggaatcatgggagccgctgccttggcaaccgtcacaagggcggtatagagggtcatgtaagcattaaccttatcctgctccatgcccttggcccagaaacgctcgcggcttctgcgcacataccagttgctcatgtcatccacaaactcctgcagtgaccttgcggcctcgggaatctggtaattcatcaggttatcatccacacatttaaccatggagttcatcttggaaagcagccacttatccatgacaggaagcttatcgtactccagggtgtgctttgtggcgtcgaaattatcaatattggcatagagtacccagaatgcataggtattccacagggtgcccatgaacttacgctgtccttcggtcacggccttgtcctggtatctcttgggaagccagggcgcgctgcaggtatagaagaaccagcggatggcatccgcgccatgggctgccagggtatcaaagggatctaccgcattgcccttggacttgctcatcttctgtccgttctcatccagtaccaggcccatgacaacaacattttcataaggcgccttgttaaagagcagggtggattcagccagcagggaatagaaccatccgcgggtctggtccactgcctcggagatgaactgtgccgggaactgtgattcaaacagttccttattctcaaatggatagtggtgctgtgcaaatggcatggcgccggagtcaaaccagcagtcaatgacctcgggaacgcgcttcataagcccgccgcacttgggacacttgatattcacattgtcaatatacggacggtgaagctcgatgtcctccggacagttgtcggacatgctctttaactcttcaatgcttccgatggaatgctggtgtccgcacccgcactcccagatattaagaggcgttccccaataccggttcctggaaatgccccagtcctggatattctccagccagtcgccgaaacggcccttgccgatggcgtcaggcacccagttaatggtattgttgttgcggatcagatcctccttcacagcagtcatcttgatgaaccaggattcccttgcatagtaaatcagcggtgtgccgcatctccagcagtggggatagctgtgttcaaaagcaggggctgagaacagaagcccccttgacttcaggtcctttaacaccagcgggtctgcgtccttgacaaaggtgcctgcaaatggtgtctcacttgtcatatcaccctttgcgtccaccagctgtacaaagggaaggtcatatctgcgtcccacattggcatcgtcctcaccgaatgcaggggcgatgtgtacgattcccgtaccgtccgtcagtgttacgtaggtgtcgcacaccacgtaatatgctttcttgtgctgcttctcagcaaggggcacggagcacccgtacagaggctcgtattccttatattccagatccttgcccttgtaattctcaagtacttcgtaatcctcgcccagcacggtggcggccagggcctgggcaatataataggtatagccgtccccggtccttaccttcacataatcctccaccgggttcacgcagagggccaggttgcttggaagggtccagggcgtggtggtccatgccaggatataggcatcctcgtcctttaccttaaaccgcgcaatggcggaacgttcttttacatccttgtaaccctgggcaacctcatgggaggaaaggggggtcccgcagcgcggacagtagggaaccaccttaaagcccttgtataaaaggcccttgtcccagatctgctttaacgcccaccactcagattcaatgaaattattctcataagtcacatatgggtcatccatatcagcccagaaaccgacggtgttggagaaatcctcccacatgcctttgtatttccagacgctttccttacactccctgatgaacggctccagcccgtactgttcaatctggtccttgccgtccagtcccagtttcttctccacttccagctccacggggagtccgtgggtatcccatcccgccttacgcggcaccatgtagcctttcatggcccggtatctcgggatcatgtccttgatgacacgggtttccacgtggccgatatggggcttgccgttggcggtgggcggtccgtcatagaacacgtaaggcttgcagccctcgcgcatcttgatgctcttctcgaagatgtgctcatcttcccagaatttttccacttctttttctctttccacaaacttaaggtctgtggagactttgtcatacatccttggattcctccattcctagttttatatactctggtatgtgctgtgttatatggattcatataaaaaaggcttccgtcccgaacaggacgaaagccgtaaataactccttcgtttaaccacctattactgcataccatcatatgagtccctttaacgcaggaattgcgtcccggcttaccatgcggcgtgtccatgcatcccctggatgcctgcggaccttgtcccatcttctcagccggacagctccggagtgatattcagtcctgcattactggcaccgggcttccaccatccccggctctctgaggcgttcctgcagacctactgtctccttcacagcttttaccatttaacttctttattataataatgccttggggaaatgtcaaccttaaccgcaattttaatcacacacagcccttgtccggtgtaattattctgttacaatccatcatatactgttgacaaatacaactgacggcgttaatattatacactataaatatttaacattgttaactatttttccaaaaggaggaaaaacatgtcggatgaacggaatgagaaaatacttcagtcagagctgatgcagatcatgcaaaggatgaagaaaatcaggctgaatatcttatccgagcaggtgatttattcggaatattatgcattggaacagattgaccggtatgtgaaggaacatccgggttccatcggcatctatgtgtcggagctggccgaaagcatgaaaatcgtgccctcttccgcctcccgcctgcttaacaccatggagggaaaaggacttataacaagaaaagtcgacaccggaagcaggaggaatattttcgtatgcctgacgcctgcgggcagggatatcctgaccagcacggcccgggatatggatcttctgaaatcacagatcatacggaggatgggaccggaggatatatcccggctcatcggactctggggaaagctggccgatatcatggaggacgagatgcaccagcttctggagcgcaggaaaaagagaacggaggaacggccatgagacgcagctgcattaccattgaacggcaatatggaagcggaggacgggaagttggacggatcctgtcccataagctcggaatccctttttatgacggggaactgctgcttctggcagcggagcggttcgggctgaatcccggggtcctgaaggaaaaggatgaaaaacgcagcggaagcctgctccacgacattgccgtgtttgcgggcagcatgcaggattacgggcggatgtttgagccttaccagcagtttgaggcggtcagtgagaccatacggcggctggccatggaaggtcccgggattttcatcggaaggtgtgcggatacggtcctgaaaaatgtgtgcggttccctgaacattttcatctatgcgtcctccatggaggaacggatacagcggatccatcatacggaccatgtgcccttaaagaacatcgaagcctatatccggcgcaaggaccagcagagaagggaatattataagatgtttgctgaaaaggaatggggcaggatggaaaaccatgacatctgcctgaataccagttccttcggatatgaaggatgtgccgatattatagctgccatggctgacagagcatccggcagcaggaagaaggaataagttgagtgtactttttcgatatttcaaaccatatacactgtacatactgctggccatcgtgctcctctttggccaggcatcatgcgacctggcgctgccggacctgatgtccgatattgtaaatgacggcatcaccacgggcaacacctcctatatcgtgggcaccggcttcaagatgctgggagtcgccctgatcagcgcgtgctgcaccgtcacggtgggtttcttaggagccagggcagctgcaggcgtctgccgcggactgcgccgggatgtattcatatccgtggaagggttctccaatgcggagctggaccgtttctccacctcctccctcattaccaggaccaccaatgacatcacccagatacagatgctgattgtcatgatgatacgcatggtgttctatgcgcccatcatggctgtgggcggcatcctccacgccctggccaaggataaatccatgtcgtggatcatcgccctggccgtggtcctgctgtttaccgtggtgttctccatgttcagccttgtgatgccaaaattccaggtggtacaaaagctcatcgaccgcttaaacctggtggtccgcgagaaccttgaaggaatgctggtggtcagggcctttgatacccaggaatttgaggaaaacaggttcgacacggtaaaccgggacctgaccaagaccaacctgttcgtgaaccggaccatgtcaggaatgatgcctgccatgatgctcatcatgaacctcataaccctgctggtcatatgggtcggctccaaccaggtctccggcttccagatggaggtgggcgatatgatggcctacatgcagtacgtgatgcagatcatcatggccttcctgatgatgtccatgatgttcatcatgatcccaagggccattgtatccatcaaccgtgtggtggaggtccttcagactaaatcaagtattaccgaccccaggcatccatcatgcccggataaggtccgcggcgtggtggaataccgcaatgtgtccttccactatcccggcggggacggggatgtcctttcagatatcagcttcactgcccttcccggacagataaccgccttcatcggcgccacgggcagcggcaagagcaccctggtcaacctgctcccacgtttctatgatgtaaccgggggcgaaatcctcattgacggtgtcaacatcaaagactggccccttcacaagcttcgccagagccttgggttcgtgccccagaaaggaatcctgttctcaggcaccatccgctccaacctggcttacggcgaccggacagccagcggggaacagattgaacgttccgcccgcatcgcccaggccatggagttcattgagtccaaaccagacctttttgacaccatgattgcccagggcggaggcaatgtgtccggcggtcagaagcagcggctgtccattgccagggctttggtgaaggatgcgcccatcaatatatttgacgacagtttttccgccctggattttaagacggatgcaaagctgagggcggccctgagggaagaaaccggtgacacgacccagttcctggtggcacagcgtatcagcaccatcatgaacgcggaccagatcatcgtactggaccacgggaagatggtgggcaggggcacccaccgcgagcttatggcaggctgtaaggtctaccgtgagattgcactgtcccagctcagcgaggaggaattgcaatgacagaacaaaaacaatcatccgctccccggatgggcggcggccgcggcatccgcgcggctggtgagaaggcaaaggatttcaagggcaccatgctccatctcctacaatacctgatggtgtacaaagcctcggttgccgtggtcatcctgtttgccgcatgttcctccgtcttctccatcataggacccaaggtccttggcaaggccaccaccaagctgtttgaaggcatgatggcctggatgatgggcaccggacttctcaccgatttccgctacataaggaactgtctcctgctgctggtggtgctgtacctgatatcggctgtattttcctatctgcagagctatatcatgtcgggtgtcagcatgaaggtcacttaccagttccgcaaggacatatcaatgaaaatgaaccggctgcccttaagctactacgacaccaggacccacggcgaggtgctgtcccgcatcaccaatgacgtggatacggtgagccagaccctgaaccagagccttacgcagatcatcacctcggtcgcgaccctggtgggcgtcctgatcatgatgatatccatcagcatccggatgaccctggtggccgtcatggtactgcccctctccatgggcctgatcatgggcgttgtgaagaaatcccagcgctatttcaagggccagcagaaaagccttggaatgctcaacggacacatcgaggaaatatacggcggccataatgtggtccaggtctttaacggcgaggccgaggccattgaaaaattcacggaaatcaacgatgagctttacaaatcagcgtggaaatcccagttcctgtccggcatgatgatgcccatcatgtcattcgtcagcaacctgggctatgtgtccgtatgtctgttaggcggatatctgaccgtaaaaaaggtaattgacatcggcgatatccaggctttcatacaatacatgcgctcctttacccagcccatcacccagattgccaatatctccaacacgctccagtccacggcggctgcggcggagcgtgtgtttgaattcctggatgagcaggaggaggttcctgagactcagacgcccatacagccggaacaggtgcggggggatgtggaattttcccatgtgcattttggctaccgtcccgacaaactgatcatccatgacttttcctcggtcatccacgcgggccagaccattgccatcgtaggccccaccggcgcgggcaagacaacggtggtaaagctgcttatgcggttctacgaactgaacagcggcagcatattcatcgacgggcataacatcctggatttcaccaggaacggcctgcgctccgtgttcggcatggtactccaggaaacctggctctacagcgccagcatcatggacaatatccggtacgggaattttgataaaaccgatgaggaagtcatggcagccgcaaggaccgcccactgtgatgaattcatccggtccatgccgggcggctatcatatgatgattaatgaggaggccagcaacctgtcccagggccagaaacagcttttaaccattgccaggaccatcctggcagacccgcggatccttatcctggatgaagccaccagctccattgacaccaggaccgaggttctgatccagaatgccatgaacaacctgatgcagaacaggaccagctttgtcattgcccaccgcctgtccactatccgggacgctgatttgatcctggtcatgaaggacggcgacatcatcgaacagggtaaccaccaggaactgctggagaggaagggcttctacgccgacttatatcaaagccagttcgcactgaacacttagcgccatcccgcacgcccaatggcggaaggcctgaggcttcatgaaagaaaatgaaaggtgaatgaaatgaacgataaaatccagaacaatatagatggggaagaaaccagcggcaggaagggaaaactcaaaaaaatcctctaccccctgctcttcgccgtggtcatcatcggatgctgcaccggttattacctgttcagcgtaagcacgaactatttcagcacggataacgccaaggttacggcaaagctctattccgtcatgccagttaccagcgggaaactgatatcctgggatgtggagaacggcgacctggtggaacaggaccaggtgctgggccgtcaggaagtgcttccgtatatcacgtcccccataacaggaaccgttgtcaagaatgacggcgcggccaaccagaccgtggccgcaggcacgcccctggcagtgattgccgacacctccaacctgtatatcggtgtcaatgtggaggaaacagatatcatgaaaatccatctgggccagctggtggatgtcaggctggacgcatatccccacaggacatttaagggacaggtaactgaaatcgacccggcaacccagacttatttcaccaacaccaccagcttttccaccagcgggacctacaccaaggtcacacagctgattcccatcaaggtcaccatcgagaacaaggaaaacctgcctctggtgttcggaatgaacgcatctgtaaaggtacatttgaaataaggaaaaacgggaggaatcataatgaagaaattaataggaatcggagccggccttatgctggccgccagccttatcaccggatgctccggtaacagcagccagaccgaggtgacaaccgccattgcaaaatcaggcagggacctgtcctccatggtatggcagggaaccgtggaggccatgagcaccattgacatcatgccggaaaccagcggcaaggtaactgcaatcattgcttccgaaggacagcatgtgaacaagggggatgtgatattccaggtggatgacaccaatgccgccctctccctgcagcaggcccaggccggatacgatgctgcccaggcagcattcggcattgcaaaaaaggcaagcgaacagaatacaaacgtggccccggcagaaatcgagtacacggacgccaaaaataattttgcccgtatgcaggccctttacgctgccaatgcaatctcccaggtggattttgaaaatgcaagatccaggatggattcagccgaggcaaagctccaggcagccaggaacggccaggacggcaattacgattcagccaaggcccagctggacagcgccaaggcagcccttgacattgcccagaaaaaatacgacgactgtgccgtcacctctcccatcaccggaatgataaccaaaatcaatgtggaaaccggccagaccgtgtccccccaggatacaggcgcaaccgtcatggatgacagcggggaaaaggtggaaatccaggtagctgacacggatatcggccagctggcaaagggcatgcccatggatataagtctccagtccgccggaaagacctgccgcggcagcatatctgaaatctctgctgtctgcgattccaaaacaggcatgtataccgtcaaaatcctgctggacgctgatgacagcctgcacgacaccggtcttatggcagatgtccgcgcctctgtcaatgaaccttccgcatccgtatatattccatccaaatgcatctttaccgatgatgatggggattatgtatatgtggtgtccggggaacaggccgtgaaaacgcctgtcaccaagggcaggaagaaaaacgcctacatggaaataacccagggtcttacccaggacaatgaggtaatcctgcaaagcagccattccctggaggacggcatgaaggtgcgggtactgaccgtcaaataggccggaaacagcgaacggtgccgcagtaaggattgttatatttttaacatttcctttgccttttgtaaaatctgtgctatactacttagcaacatacaagcgcagccgtcaaaatacagcgattccgcatatccgcggacagctcccggccacgcaccagggaggaacctatatggaacagagaaatcttacgttactgacagacctgtatgaactgaccatgatgcagggatattttaaggaaaaagacgccaacgagacagtcatctttgacatgttctaccgcaccaatccccacggcaatggctttgccatctgcgccgggctggagcaggtgattgaatacatcagggacctgcattttgacgaaagcgacattgagtacctgggaagcctgggtatattcgaggaggacttcttaaaatatctccgcggcttccgctttaccggggatatctacgcgattccggaggggaccatcgtcttcccaagggaaccgctggtcaaggtcatcgcccccatcatgcaggcgcagctggtggagacggccctgctcaatatcatcaaccaccagagcctgatagccaccaagaccgagcgcatcgtgtatgcggccaagggcgacggcgtcatggaattcggtctgcgccgcgcgcagggaccggacgcaggcgtttacggcgcaagggccgccatgattgcgggctgtatcggcacctccaatgtgctctgcggcaagatgttcgatgttccggtcaagggtacccatgcacacagctggatcatgagtttcccggatgagcttacggccttccgcacctacgccaagctgtatccgtccgcatgcatcctgctggtagacacctatgacaccctggactccggcgtccccaatgccatcaaggtatttaaggagatgcgtgaagccggaatcccccttaccttttacggtatccgcctggacagcggcgacctggcctacctgtccaagaaggccaagaaaatgctggacgacgccggattcccggatgcagtcatctccgcttccaatgacctggatgaaaacctgattaactccctgaagatgcagggcgcaaccatcaactcctggggcgtcggcactaacctgattacagccaaggactgcccgtcctttggcggagtgtacaagctggcggccgttaaggacaaggccaccggacagttcatccccaagatcaagctttcagaaaacgcagagaagatcaccaacccctgcaacaagaccatacagcgcatttacgacaaggccacaggcaagatcatcgccgatttaatctgcctggtaggcgaggagttcaacacggaaaactccctgctgctcttcgaccccattgaaacctggaaaaagaccatgctggcccctggcagctataccttaagggaactgcttgtgcccatcttcctgaacggccagtgcgtatacgattcccctaaggtaatggatatccaggcctactgcaagaaggaactggacacgctctgggatgagtccaaacgtctgattaacccgcacacggtccatgtggatctgtcgaatgaattgtggcatattaagaatcagctgttggattcgttccataggaattaaagttggatttaaggggtgggattctatccctactcccggtaaggtcagtttacagggaacaaggcacatattatgaaatgggctgctgacaaaaccaaaaaagaggacttgaaaaattcaagtcctccgtgtataatttacttagaagtaatcaaaagacattagctggtctgatgattgcgcttcggataactacataatttttagttacgcgctatcctctatgccagtagaggatagctattttttgtcatgatgattgtctatgtaagttaatgccgcaaaaatcaccagcactaatgtcaacacttcaagtgtatccattatacatttcctccttcgtttatttccgaaggaaaccatcagactatcctctgacttctgttagattatacatagacattttatcataacgaaaaagcaaatacaatgataaccatggtatatttcaattggtgcatgactacggtttgcaacagaccacattactctttacaatcttcatcggacatcagtattggcaatcctgttttctgctcaaaagtaagtgccatcaatccgccctcatctttggataggttttcttgtagtgcgtccaaaagaaacggtgcatccactgtatcacaaatgtcctctgcggccacaggagacgctttaaatcataaacccccatcccccaccaacaacggcagcacattctggggcagatcatatatcaccatatccgccttctcatccaaaggcctgggcgccctgtggatgattatcatcttctttccctggaaataccggatataatgactgtatacatcggagcgcaggcttgttccaagaacaaggagtacatcggctttggatatctcctgggtggtgcggcttaccatctggctgtccaccatttccccgtacaggaacgtgcctgggcggatgatgtggccgcagtcctcacacagggggacgtgcctggaattccttatgtagtccatggagtaatgctttccacagtgggtgcatgtattttcatatatcccgccgtggaggtatatcacgttttttgtctcagcggaccttggcaggtcgtaaatgctggtggtcaccatgcactggagcataccgcgcctttccatctctgtcagcgcctccacggacggggtcatccttggtatcttctccagtatctcacgcctgtaaaaatcatagaacagttccggtctcctggaaaaacaggatatatggaacagctcctccggggactgcccatattcctgctcaatctcataggcacgtccctcctgtttaagtcctaagataccgccttcctccagcattccggaaccgcagacagctaccgtataacggctctcagccaatgcctctttcaggagtttcaatgtttcctcacctatcatactgattctcctccctatctcatttctgagtcccattataccgcaatgtccccttgatgaccactggatttcacaatatttaccgccctttcatcgacaaaacacgcaggcagtactgccctgttttattttatgtacccgttgacacagatggctccgtagggacggatgctcatcctgaaggcgcttcccttgcctgtgcagttttcaatgtaggtgatgtattcatccaccagttcgttgggcagcatggccatgatgacaccggcgaacccgcctccgtggacacggcaggcgcctttctgcttcccggcaatgaacagttccgtgagggccagggtcacggtgattccctgttcctgataattgctgttggtaaagcagttctggagccatttccaggaggaattgccggaagctgtgatattggctaagaagtcttcaaaacggttctcctttaaggctgccacctctgcttccaccctcttgttctcctcaaagaaatgcagggcgcgcagcacggaacggtcgcctgcaaactggcgcacttctgccaggttactgattacctcctcctctgtcacctgtgacagaacttccttgccaaagaactgagccaccttcttcatctcattggggacggatgaataatcggcgctcaggtccgcatggccttttccggtctgtacgatgatcaggctgtggttctgtgagccaaagtcaaaatctatcttctccactgccggtgcgctgggttccacgaagtcaatggtaatcagcccgcccaccgcgcaggccatctggtccagaaggcctgaggccttgtcccagtagttattctcggagtatttgccaatatgggcataggccacggtatccatacggccctcattgaaaaatgtattcagcatggaacacaggagcatctcaaaggatgcggatgaactgacgcctgccgcgctgatgacattgcttgttatatatgcattaaatccgcccaccgaatacccggactcctcaaatccctttaaaaggccctttaccaggtccacggtccccgcctttttctcactgggttccagatggttcagatcgatggtaaagtcctggttgtatgtctcacttacaatatgtacatggctggagctgttttttgcggcaacgcccacgcaatccaggttaatgcttcccgccagcaccttgccgtgattgtggtccgtatggtttccgctgatttccgtgcgtcccggtgaggaaaataagagcacgtccccgctgtccccaaaggtcttctcatatcctttcagcagttcctgataccgcgccacgttccctgccacggcatcctctccgtataacttagccagaagtgttttagcgccttcactttccatcatctgaatggtctcatttaccttcatgccttacctctcctttatcatacacaaaatcaggggcgggcacccctgtctgggattagtttatcacagcatggcctgtgcccacaatagaatattttatgtctttgtatcaatttttatggaaatgcccccggtttcctgctataatccaaaaatgaaaattctaaaaaggcggtgcccctgatatggactggaacggtaaaccctatcattccctggactatgagttaaaaaaacaatttggtcaaaaagtgtataagctttccttaaacggcggcatgacctgcccgggccgtgacgggacccttggcagcggcccatgtatcttctgcagcgcaggaggctccggggactttgccgcacctgtgatggattctgtccatgaacagattgaagctgccaagctgcaggtgcaaagaaaaatgtccggccctggttcctatatcgcctatttccagtcctataccaacacctatgccccgctgtcccatctcagggccatattcacagacgctatccgccaccctgacatagctgccctgtccgttgcaaccaggccggactgcctggggcctgaagtggtggatctgctgcgggaacttaattcaataaaaccggtgtgggtggaacttggactgcagaccatccacgaatccacggcccgtttcatccgcaggggctatcccctgcctgtcttcgaatccgcccttctccggcttaaggaggcagggattacggtcattgtccacgttatcctgggacttcctggtgaaaccagggaaatgatgcttgagacggtaaggtatctggcgaagggtgtggtggacggcatcaagcttcagctgctccacatcctgaacggcacggacctggccaggatttaccgggataccccctttccggtgctgtccatggaggaataccttgaccttgtgattgactgtgtggaactgctcccccctgacatgaccatccaccggattacaggggacggtcccaaaaagcttttggtttccccgctgtggagcgggaataagcgccttgtgctgaacagccttcaccggcgttttaaggaaagggatacgtggcagggaaagcattttcctctatgaatcccaatttttagggaatgaaacccttgtgctgaaaagcaattcgtcgtatactataacataatgcgaaaaatcaggaggacatagtatggacaaaattaagatgaccacccccatcgtagagatggacggcgatgagatgacaaggattctctggcagatgattaaggacaacctgcttctgccgtacatagatctgaagacagagtactacgaccttggcctggaatacagggatgaaaccgatgaccaggtaaccatcgattctgccaacgccaccaagaagtacggtgtggccgtcaagtgcgccaccatcacccccaacgctgcccgagtggaggaatatcatctgaaggaaatgtggaaaagtccaaacgccaccatccgtgccatcctggacggcaccgtgttccgcgcccccattgtggtgaaggggattgagccatgcgtaaagtgctggaaaaagcccatcaccattgcaagacacgcttacggcgatgtctataaggcgtctgagatgaagattccgggacccgggaaggtagagctggtatacacggctgaagacggaacggagagccgtgaactgatccacagctttaactgcccgggaatcgtacagggcatgcacaatgtgaacagatccattgaaagctttgccagaagctgtttcaactatgcccttgataccagacaggacctgtggtttgccaccaaggataccatttccaaaaagtatgaccataccttcaaggatattttccaggatatttttgatgcggaatacgcaaagaaattcgaggacgccggaatcacttatttctacaccctgattgatgatgcggttgcccgtgtcatgaagtccgagggcggctatatctgggcctgcaagaactatgacggcgatgtgatgagcgatatgatttcctctgccttcggttccctggccatgatgacctctgtcctggtgtcaccggacggcaacttcgagtatgaggccgcccacggcaccgtacagcgtcattactataagcacttaaagggcgaggaaacctccaccaactccgttgccaccatcttcgcatggacaggcgcccttcgtaagcgcggcgaactggacggcaataaggaactgatggaatttgcagacaggctggagaaggccaccttggataccattgaggaaggcgagatgaccaaggacctggccctgatcacaaccaatccaaatccggttgtactgaacagtgaggactttataaaagcgattgcgcgcaggctatagatattggtattttcaaattaaattaaaaataataaaacagtgtgcatggcgtatggatattatatcagccaggcacactgttcttcgtttgaaagatattcccaacctattgctgtacagagctattgctgtacagagatacggacgctttagcactgggggcagcgcctggtttacccaatctcacctgtcgggatacttgccggggaagcgtatctaagaacaacccgctgactgcaatatcccatagggatttcagtttctttatccactatttcaatccaaatgttaacatcatggtcgttgcaaaattgtgacagctcataagcagataggccttccccggtaaaatccatattgtaatcccgatcgtattcaagtggataaaccacggtttccttcaaggacatgatttgaccatccggatatattatgccgcgaagccatatctcatgaccggcaggattaatattacattttgaactgggtaagcggaatgtgcctacactgtcatctaaaatataacacagtttaccatgatggtattcactttcatagagaggaaccggttcgccttcaatcgctatggatgcgttttcattccagcaccggatgccattattactgactgctttaggcccggcattacattttccatccttgtccacctggtatccatccggggttattgtgtcagaaagcatatatccattatgatcaaaatagtagcattcggattgtattagaatccattcatcatatggataagagccatcatcatattgataccaccagccattggcgtccttttgccactgtccggcaaatgcggtaaaactcatactgattgataataatgcggttaggatgattcttttcatagttacccccttattgattaaaaagagattattgcttccatccgccgggaagtactgcacgtatgccctttacttcccttccggctgtctcccggttcctacccactgattatctcttctaccagcgcccgcacatgtatcttcatggtatccagacatggcaccggggaaatccggtcattgagggccagcggcagttcggtgcagcccagaatgacggcctgtatgccatcttcctccaccatcctccttatgatcctcacaagcccttcctgtgtctcttccctgacatccgcaaattccagttccgtgtatattttctcattgatatattccatctcatcttcccggggacttatgacctggatgccgctttcttcaaagggcctttgaaaaaagctgcctttcatggtaaatattgtccccatcagccccagtcttgtcagtccccgcctgtttgcttccccacaggcagcttcgatgatacttaccagagggatgggcgtctgcttcttcagctggtcaaatacgatatggggcgtgttggcggacagtgcgccgacctccgccccggccgccgcaaggttcctgactgcggccagcaggtaagcggtcagctcctcgtagcgcccttcgttgcagaacctctggatgtcaaatacattcacactttccagtgaaagaaaaggcagtacattttctcccatcctctcacggaccccatagatgatccccctgtaatagggaaccgtggattccggtcccatcccacccaccaatcccaattttttcatggcatatacctccgtatactctgcctttatccatatggctggatgaagcatccagggtgtgtctgaacatacattcccgccttctgccctaagggatccacaggaatccaccaaaggtacccacttagggtaaagcacgccctggcccagatcagctgaaccatactggaattccggctttttatgtctatagatacaggatactactgacaccagctgttttcaagctgaaatgcgattgaaatgtgccccaaataaagctataatggataacatcacgatacgttaaaggagaaggatatggattacaggacatatttaaagaactatcccgataaggacggccgttttggcccttacggcggcgcttacctgaccgatgaactggttcctgcttttgaggaaatcgcagacgcctaccagaccatctgccactcttcccagttcatcaatgaactgcgcaggatacgcaaggagttccagggcaggcccacgccggtttaccactgtgagcgtctgtccaagaaaatcgggaactgccagatttacctgaagcgggaggatttaaaccataccggcgcccataagctgaaccactgcatgggcgagggcctcctcgccaagttcatgggcaagaagcgtctgattgcagaaacaggcgcgggacagcacggcgtggccctggcaacggccgccgccttctttggcctggaatgcgagatacacatgggtgaagttgacattgcaaagcaggcccccaatgttaccaggatgaagatcctgggggcaaaggtcgtaccggtcacccatggccttaagaccttaaaggaagcagtggattctgcatttgaatcctatgccaaaaactacaaggactccatctactgcatcggttccgctttaggcccgcatcccttcccactgatggtgcgggatttccagtcggttgtgggatatgaggccagggaccagttctatgagatgacaggcatgtttccggatgaagtgtgcgcctgcgtgggaggaggcagcaactccatcggcatgttcatcccgtttttagatgacccggtagacattaccggaattgaacctcttggaagaggtgaaaagctgggcgaccatgcagcttccatgaaattcggcgagaagggcatcatgcacggctttgaaagcatcatgttaaaagatgaaaatggtgaaccggctccggtttattccattgccagcggcctggattacccatccgtgggaccagaacacgcgttcctccatgaccttggacgggtcagatacgagacggtcagcgacgaggaagccatggaagcatttttcaaattatcccggtacgaaggaatcatcccagccattgaaagctcccatgccgttgcctacgccatgcgcagggcaaaagagatgaggcagggttccatcctggtatgcttaagcggcaggggcgataaggatattgattacgtggttgagcattatggttatggggaacagtttttagacggacaggaataaatcatgccagatacatgaaaatggacaggaggcctgaaggggcctcctgttttccatataattcctattttcggatattaaaatatacctggcctgcttccagggggacacctttggcagcatacatctcgctgaccgtgacaagctggtaaccctgggcaaccagttgtgggaccgctgcctcaaaggcttccgccgtggatggataaaggtcatgcatcagtatgatgctcccatcctttgcctgggataacaaggtggaaagaatggcgtccttatccttactggaccagtcttccgtatcaatattccactgaatcatgggataggatacaagccctgatacctgtcccttaaatgcgccgtaaggcacccgtaccagtttgggccggaagccggtcactgcctccactgcgtcattggtcatctctacctgggaaatgacttcctccggagcaagattttccaggtttttatggttatatgtatggtttccgatttcggacccggagttgtggatccgtttcagggtatctttataatcattgacacggcttccaacaataaagaaggtggccctgcctccataggcatccaatacgtccaggatcctctgatccacctttgtgaaaggaccgtcatcaaaggtaaatgcaatcatgggttttgacgcatccacaggccctgggattgaggacagttttcctgagggatcaacgctttctgccgatggtgcggcggctgatggacctgccgccacggctggtccatattcattgccggatcctcccagcggctcaatggtcttaaggtccggcgccgtgactttctcagcgccatctgaaacagcagttcccggcgcagcgcctgagacagcccccgtgaaaggcggaaggttttgattccggccagggcctgtgagttcagcttttgccttggaattgccgttattgggattcgcactattaggattcgtactattgggatccgtactattgggatccacactattgtgatctgtactatttgaacctgtattatttatacctgtattatttgtatccgtattgtttgtatccgcattgtttttatccgtattatttatgtctgtattatttgcgtccgtgctatttgaatttgcctgatccgcatctgtgcggtttttgtccgtatctgtacggtccgtacccgtcccttctgcgtcaccgctgtccgcatccgattgactggttcctataccgccgccggaattaccgtttccatcctcaccgcttccacctggcccggcagttccgtttcctcccataattcctccattcccctctcccccgttcatgcctgccccgattacggctgtccaggcagaggaaaagaaaccatggtccccggcggacaagttctttccgtagtaaaatagttgtgccacacagaacacggccaccaggaccatggtaagctttcctccaaactgcagggttgagtggacgccttccctgcggattttggcacggcgtgttctgctgggctgcctgcgcggtttgaagccggcaggtttcttcttgtataaggattttgtatgggcagctttatttgcctttttctttgtgttataaatcatctatatttatctcctgtataacctaatgccgccttggcataacgatactgatatgaggcacgctgccgccgatacagatatcaggcaccctattcacagttatttgcgcaacgcggtactgggttaatcactttactctattagacggaaaaacatgtgaaaaagtttcacatctacgaaaataatgctgattccagaccagcctttccattgtaatcatatgcagggattctgtctatggatttaatgaaattgaaagaatagtttcagaaagaggagtagggaatctccggctatcaagcctggaatcctggaatcgtacaaaataaaaaggcccggatcattccatatttatcaggaatcatccgaggccaatattttcttaatttcaggatgtgtgacacatatataccagcagggacattcagtccacatgacgggtcaggacaatcggcagccgggcgcatggcgcttcagctcaaacaacaccgggcacactgcactccagcgcaaacaacatcggacatattgcgctccaacgcaaatatcaccggacacattgtactccaatacaatcagcagtccggggacatggctacccgcctgcccccggactgcttcgggaatgatgcttcccggcctattcttcagacattgcccttatctcctcattaaccatgacatcataagatatgctggtcatatactggtaaaactcctgcttttttgcatcttcggttatggcgcgcgtatatccgccggaggaagtacctggcaccatctcaagtgaaagcgcctccccgtcccagtcagccttaaggagcgctgtcctgggaatgctgctgccgaatatgaaattaccaagactgtatataatgggcttccctttataatattccattccctgaagcacatgggggtggctgccgattaccatgtcggcccccgcgtcaatatactgtttccccatggtcctctggtactcctgggggcgttcatcccgctcaattccccagtgcacatatacgataacaaaatcgcatgcttctttggctttctttatctcttccagcagcagggccgggtcataggtggtcagcatacccgggccattggcagtggcattccacgaacccacggggattaccctggatgctccgagaaagccgattttctttccttttatttccatgatgaccggcttttttgcctcatccaggttggcgcctgcgcctaccctgaatattccggcctgatccagtgtatcacatgtgtccagcagggcatcggtcccaaaatccagggcatggttgttggcaagggtcacgatgtcgattcccagctcctggaatatggatgccttctcaggaggcaggcggaaggtgaactgtttatccgccgctgccgctcccctgttgctgaatggaaattcctcatttaccatgaatacatcgctgctgtcaatgatggaacggaacgtcccatccaccacaccgcttatattcccggccttatcataggcgcccagtacatggtctgataaaagtatgtcccctgcaaacacaaagtggatgacagggtcctctgccccatccacaccaggctccccattgtccatgtcctggtcctgtccgtttgcggctgttcccagaccatcttccagggaagccccatccgttccaggcccctggccgtcccctgcttttgccagctgtccctcagatgcagggtcccatggcccgtcgctgtcccagggttcgttcccgccccggtttccatgcaggctgtctccatcctccggcctgccttccgcctgaaccggattccctgatccgccggacatttccatatccggtgcgctgtctttgaaggagcctatatcctccgccttcacgtatctgttatgggtggcgctccacacaagatatccggttattcctgccagcatgattccaaggataatcacggctgtcagcattatgttccttctgttcattcaaaacctcttacgtcaaattgccaggatgattcctccgtcattggcatatacagtggctaccccggccgcggttgtaaccaggacgtctttaaactgccctctcttcataagctctgtccttgtatactctgcccgctccgcgttgttcacatggcagaccaccgccaccttatcctttgtatctcctgcttcttttaccgcgatatcgcacatacgctggagcgccttgttgattcccctggcctggtccagcttgatgatgacgcctgcatcggcgcccatgaccggcttgatattaagtgcggttgcaaaaaatgcctgcagccctgaaagccttccgttcttgcgcagtgtatccaggctctccaggacaaagtaggtatgcatcctgtccctgaacgcaagggctttctcaaggacctggtcaaattccagcccggcttcacacaggttctggatgaacagaccaatattaagctcgcctgaggacgcggataatgagtcgatgactgctacctgctttttctgggcctgttcgcccttttccgcctgctcttcctcatacagcttcttggccagcgccgctgaattataactgccgctcagatgtcctgacagggtgattacaaatactccctctgcatccgccgcctcatacgcttccttaaatgtctccggcgaagggcatgctgtcttcgggcattccgggcaggcctttaccatatctatgaatttcttctggtcaaatgtctcatcatccaccacggttgcattaccgacctgcagcgtaagcggtatcatctggaatctggaatccttctttaactcatctgtcagatcaagacagctgtctccaataattttgtaggtcatacaaaagtcctccggtttcttatccatgcttttaacatgtagtattgattactacttattataacagtatgcattataaaatgcaatccttaatgtaggcaatcaatgaccgaaggacagacagcaccgcatccctgtccttgcgggcaggagggaccctgcgccatgcctgttccagggtgatataggctgcaccggatagtgtggactcccggcagaccctgaacccctgtgcatccatctggaccatccatgaggtgccgtggcaccagcagtttatatcaggcaggcagatatcgtccgtcctgtctgcaagaaacagccggtaggagggaaattgttccatgcgcccagctaattcctccagtcccctggcatagtgaaacggggaaataaccacctggcggccgcagataagcgacaggctggtgcttacaaaacgtgtgcggatacggcatttcatctcatccagctgcaggatctggatgatttcctccccggttcccggcagatgtttttcctctggatctcctcccggcggctggcctcccggcagactcccacccgccggctggcatcccgtcaattgcccttccgtcggctggcatcccgtcaattgcccttccgtcatccggcgcaggaaccggttcacctgcctgcaccgcagtgcggcaagccctgataccccattttcctgaaggatgtcatccatcagtttttcccccactgtcatgaatgcaggcgcgggaagataggataaaagcttttccccttcccgggcaaggccgtccagaccgctgattgatccatgttccatatcaatggtaagctccgtgaacatggggcggcagctggccagcaccatatggaacacgttcctgtgctggaggatggaatatgcgtccgtatagaccgtggtggaggtctggtccgtggccattgacatcccggtaacactcattgcatgttccaggatgaaaaaggaaaaccagtatatattttcgtcataatactgatgataataccagtgtgcattgcgatggaacataagagggctgcacagctggaaaaacgatatgaacccgtcaacggaaacagaaaaatgcaacgcggcccggaaggtgaatccccggtctaaaagcttaagcatccgcctgacccaggtcctggcaaaatccatatcctccagcagccaacggctctgttccgaatccacatatagcatttcccccggatgttccatggcctcggccacatccaaaaggtcggatattgcctgccgccttccttccgtgctggtatagacagctatctccgccgtgcacactgcctctgtccgcagggtaaatgccctgggtaccgtaaaatggcggtcagtcaggacccgccttaaaaggacggcctcatccattggcgccgcctcgtcctccagtgggatcagggagcgcagggcatcgcacagggctgtcctgtcctgccccagaagcatttcacagatatcctcaaaatacacggactttacattcaggcggcggtttccgctgcgccatttgctgaccaggctggcatccacatgaagcctgcgcgccaggcctgccgtggaaagccccagcctatccataagatagcccagggtagacagttttttctcagtcatggtaatctcctcctcatgatattcctgtttttacatggcagacagctgtcacggtacacggtctgacaaaaggcctgaatccctttccaaatgaatctgacattgttatactataggcatgacagcgatatgcacaaaaatataattatattgctggtataattagttatttttactttttgtgcacctggtccggaacaggcttcgcaccagtcatagtttaaagtcataggttgaaaaataagtgtcaataatatgcgttcaaaaggaaaggagtacatacttcatggcagaaaacaaggattataagtttgtggaccattatgagtttgatgaggaacttcttaaaaaggcatttgctgaggcacgtaaaatctataaagagcgtggtttcatgcgcaggatgggttttggaaaggctcccgccatcaccaccgtggacatggcaagggcatggatgagtgaaggccatccatttacctgcgaccactccgaggaggtctgtgccaatgccctgaaggtgctggaagccggacgtaagtctggtgtacccattttccatacaaccacgggatatatcggcaagcagcagtgggaccttccccgctgggatgagaaaatccccatgagcgccctggacatcaactccgaatggctggaaatcgaccctaaactgaaaccgcttcccgaagagcctgtcatccataagaaatacgcctctaatttcttcgggacccaccttgcccagacacttaacttcctgggcgtggacaccctgattgtcatgggagcaacctcctgtgcctgtgtacgccatacggtcatggattccaccggctatggatttaagaccattgtaccggaaggcactgtgggcgaccgtgttcccggcgtcattgagtggaacctgtttgatatggaggcaaaattcgcggacgtggttcctgttgacgaggttgtcaggtatctggagggaatcgattccagcgtatacaccaaacacgaaaggtccttggaccagtaatgattgattcctggcgtatcatgcatccatgaaaggagttaacatgagccttctgattaaaaatggaaccattgtcacagctaccagcgaattcacaggcgacctctacattgagggagaaaccatccggcagattggattcaatctgaaggtggatgcggaccggattgtggatgccacaggcagatacatactgccgggaggcgtggatgaacatgtccactacggctcctttggtggacggctttttgagaccgccgaggcagcggccgtgggagggaccacaaccattgtggactttgcgccgcaggaaaaggatgtgccccttttagacgccatccgccgccaggccgccaaggcggaacatatctcctctgtggattttgcatttcatgcagtcatcatggaccccaaggaatctgtttttgaggaagtcaggcatctgcccgaggtgggcgtggccacactgaaactgttcatggcatacaaaggcacttctttttactgcgacgacgaggcaatcctaaacgccatgatgcgcgccaaagaggcaggtgtcaccatgatggtccatgcggaaaatgcagatatcatcaccatcctgacgaaccattatttaagccagggcaagaccgccccggtctaccactatcatgcccgtccccccattgcggaggaagaggcaaccggacgtgcaatcgcactggccaaggcggctgactgtccgcttttcgtggtccatgtaagcgccaaggaagccatggaagcaatccgtgaagcacacagccagggctggcccatctttggagaaacctgtacccattatctgacccttaccactgattatcttgacaagcctggctttgagggcgccaagtacatatgctcgccgccgctcaggccccaggagcacgtggatgccatgtggcatgctgtgcgggaaggctggcttaccgccgtgggttctgaccattgtgccctggacggcggttacgagggggccaagaaaaagggaaccaatttctccaatgtccccaatggctgccccggcgtccaggaccgtctggccctgctgtggacctatggtgtgtgcacgggaaaaatcacacggcagaaattcgtggaattatttgcaaccaatcccgccaaggtggtggggcttcccggcaaaggcgagctgcgggtgggggctgacgcggacattgtcatcttcgacccagactggaaaggagtcatcaccaacaaggacagccttcatgggattgattatgagccatttgaaggattcgagattcagggccgtcctgagcaggtgtatctgcgcggcaggctggtagcccaaaaaggtgtattcgtaggcgaacgcggcaagggacaatggcagaaatgccggccctacggcctgtgctacgattattatcacaaataactgacccctgcatagtatccatatgccaaaatagggtgttgcaaaaggcggcccttccacactgcgcatgatctgctgtttagcaggtactgattccgcggtggaggctgccatcctgcaacaccccattttatttgacattactttactgcaatggcttcaatctcgcagagcacgccctttggcaatgtcttcacagccacacagctcctggccggcttggacacaaaataggatgcatacacctggttaaatactgcgaagtcatccatgtccgccaggaaacaggtggtcttgaataccttgtcaaacccgctgcccgctgcttccaggatagcgcccacgttcctgcagctctgtcctgcctgcgcctcgattccctgagggatggtgccgtcagccggatccacgggaatctggcccgatgtataaaccaggccgttcacctcaaagccctgggaatatggtccgattgctccgggcgccttctctgtactgatgatgtccatgttaaaatacctcctcctgcattttatgttatcgcgttcacattcaactatattcattatagcagatatgccgcctgactgcaagaacaattggaaatacgctgtttttcctctgttttttatggacatccactttctccggtgctataatgatactgatttttgcgtccttacattcaactgaaataaccaatcatcaattaatccatataataagaggtgcagaaatgacagatacgaataaagccgcggaatcccttccgctttaccacattgaccatacattataccagggccgcccaactgaccttacaggccgtctggagaaagaaatccgtgcatatgacctgctggattcccttggtgtgccttataccagggtggaccatgatgcccttcccaccattgaagcatgtctcaaagtggaccagcttctgggcgctgaaatctgcaagaacctgttcctgcgcaatgcgcagaaaaccgatttctacctgcttctcatgcccgggaataaaaagttcaagaccgcagtgctttccaaacagattggaagcgcccgcctttcctttggggaacctgatttcatggaacagttcatggaccttacacctggctccgtcacggttctgggcctgatgaacgataaggaaaaccaggtacggctgctgattgacaaggacgtgctggacagcgaattctttggctgccatccctgtatgaatacgtccagcattttgctgcgcaccagggatttgattgataaaatactgcctgccacggggcatccctatacggttgtggatctgccgtatgcggagtgagggcaggattccttatttacaaaaaaacaaccatccctttttggagactggttgtctatagtctgaagcttgccctatccaagggctttttgatattcattccttcagataaacagttaacatagcagaactgtttatctgaaggccaagtatatcttaacttatggggtaaggccttttaatccatattaaatcacttttttttgacgaaataattatataaaagtaatgccactaatatggccggtgaaaataaaataatgttaataagaacctgaaggaattttcctacaatgatagtccaaagaaattgtattcccatataaagtggtcctttcacttttctttatcaatatcacatatcgtaattcaaatagcactgtatcttgttataattttcctggttatccacaaaacttattgtttgtgtgaaatatacgtttgccgccagtccattaactagaaatccaacatatccagtagtatcataccatatatctgcatatacaacatttgtcgttgcggaggttttatcaacagtacaatactgagccggaatagctgatacacttccatcatatgcggaaaacctaataaatccacctggagcaaaaatccctattcttttacatttacagatttatcatcgtaaccactcctttacatataaagattaattcttaagaaaatatattttgtattacatttatctcaactatcggtcatctaaacgattgcttttgcattgtataaaatcatatcatactatcgtagtattatatcatagaaataaaaattaaaaaagatgagtcctcaataatacagaataacgaacagcatatattcattgcatggctaaatcattgaaaactaaagcatggacattccccgtttatttatattattcgcatctcatacatccaaacaacccattcattggaacactccccttttcctttagcataccccaattatgaagttgtttataattatatttacccatacgataaagccgattccatctcaaggcatttttgttaatttcccaagagctaagtccctgatttactcttacgaggaagtgtgatagaatggaacataggatatgcgaaatcagatgtcggaggattgaacatgaaaaaattagatattaagagtctggcaataggatttatcattgggaccgtgggaataaccactgcttttgcggcaaacggcattaagtcagcagatttaagtactgccaaggtaacactggacggggctgctgtcccgctcactaaacctttagttgcggttacagcggataatgagacggatccaagcctttacatgcctgtcggtgaattacttgaatatcttggatataccgtaacatgggatgggacgaaggatacggtccatttagtttccaacggcagccgccctcacgaaataatcggcaatgttgttaccgatggaaataccgtcatgaatctaagcaataaaaatgcctttaatatatccgagtcaggttcattccaagctgaagacaatcaggtcttaaccttaaatatcacatccaccattaaaggcgggtccgttgatttatttttattcgaccccaataataaagaacagaggattacaatcggttctgcggatgcagcaaaggagattgccttatcaaaaggcatctggcagtataattgcagcgggatgtttaacgagggcgggaacataaggattgtaggaacagttaagtaaccacaccggaatcatgtgatacggacgaaacggaacatcagcaacgccaaggggccggaaaaacggagttaatcaaacttcatttttccggccccttttaggcagtgatgactgtgcacggattttcaggaaaacaaggcatcaggaaatgatgaggggaaagcttatccgtgtcaggaaaaagccgtcctcctgtccgatataaaaactcccgccatggtcctcgatgatttttgcgcaggtcttaaggccgattcctgtgctttcctttacatctgcatcccctgccacatagttgccgaaacagatgataagacaatcttcccgctgttcataggatacggttaccgggcggttcctgtccgcgtattttaacagattggaaaaaatatttccgaatacccggcggcacagattgatgtccgccaaaagcctgcaattgatttcatcggaactgcgcctgatgtcaaagccctcgctctccatgtcaaaaagactctcttccacaatctggcccaggaattcagctccattgacctcttctttctcaagctcctcccgttcccttccgtacacaatgaaatactcaaacaatttatcggaaagctccttaatctggtatgccttttcccggatggaattcagatactttttctgctgcccgccatccccctcctttcccatctggagtatgtccacataacctaacagggaagtcaggggggtacgcaggtcatgggacatggcggtgacaagttcgcggttcgcctttcccgcttcctcctccttctgctgccgttccttgatggcacagcgcatggcatcgatttccgatgccagggaggcaagctcatcctttcccttcaccgtaatccggtaatccaggtcccctcctttcagtatctgtatctcctgttccatcaaatctatgtacctgattttcccgcggatcagcatgaccagtatcagggcaaacgctgtcatggatatcacgccgcccagcacactggcagcggcatagtagccgtactccacataatagcttactcctgcctgggctgtcccgtctgcaaattgcacctcatagagccatgaagtatcttcccattcattcatttccgggaccatcaccatcaccttggcgtcattgctgtaacggaacctgccgtctttatagatggtaatgagaaggttcttctcgcctgacgcccacttgtccagcatcttactgtcatccgtggacagtccattccctgtcacatatgcctggagccgtcccacacatgcctgctccctcatgatcattctggtttcactgaaacaaacccggtccagtatgccaaacagcactgtattaagggccatatacagggccagtgaaacaagggccgacgccactgccgccatggtaagctctgtccccagcctgctgaaacttcttcttttactcaatgcggtacccctttccccatacattgacaatatatttgggattcttcggatctgcctcaagtttctttcgaagattcctgatatggaccatcaccgtattattggcgctgtaataataggcttccccccagacgctctcatagatgttctcaatggtaaacagtttgccccggttggacgccagcagtaaaaggatgcggtattccaggtccgtgagaagaatctccccgccatttttcatgacctcgttaaatgatttctgaatcaccagatccttaacagctatggattcctctccgtcctcctcctttcctttatatatatgataccggcgtatcatggcctttaccctggccgccagctccgcataggaaaatggtttggaaagatagtcatcaccgcctgccccgaatcccatggtcttgtcagaatcctgggtgcgggccgtaaggaacaggatgggggtgtttaaccttctgcgtatctctgcgcaggctgagaatccattacgtcccggcatcatcacatccagtatgatcaggtcgaatgtatcgtctgccatggacgccgcctgctccccgttctctgcctccacaacctgatatccctcgctctccagcaggatcctcactacctcgcgtatctccggatcgtcatctgcaaataaaatcttccgcttgtccaacctgacacctctcttcatgattgcatgtttttgttccatatccctgccatggatatcccagcatggtaaaactattttctattatatctcagatgccctgtctcttccaccaaaacagtcagatatatacagctgtttccattccttctgtccagccgttccccctgtcagtcatgtttgattgcctccagcgctgaaatccttactgctttgccggccgggtaataacctgcccccacgccgaccgcaatggaaaacaggattgcaaacagggacagccaccaaggtatcacggacagcctggaaggggcgcccgccatacccgcgtccatgacaattcccatgtccatggctgaggatgacatgcctcccgatgtcatattcatgatgaaagatatggcataactgaatacagtccctgtcactcctcctaaaaacccgataaagcctgcttccagcaggaatatcttccttatgtccctgacaaaacaccccagagacttcatgacaccgatttccctggtccgctcagatatggacatgatcatggtgttggtgattcccagggctgccacgaacagggaaatagctcccaggccgcccagcatcatctgcttctgcctggcctcctgttccatgggcttgcggatggtctccatggagctggtcctaaatcccatgcgttttatttccatctccacctctgccacctgattcatatccttaacctttaccaaagcgcctgaatacccttttttccactccggcttcttaccgctcagcttagcctgctggtccagtaaggtcttaagcatttccaggtccatgataagtcccatggatgtctcctccccttttccgaaatcctccttcatcctacccgcggcttccagctggcgcgtgattttcttatcatcctccttatcgctgctgatatccagtgtataggatgttttcaaagggtcaaaatatggctggggcttcacgggcattcccctttcatccaggttatcatatccgctgtacatatcaaccgtattcctgccaggaggcctcttggtgtcctcaaacatataggcaaaattctcccccacaaagacaccgtcccttcccgccttgtcccacgccccttctgtcagcttatatcccattgattcagccgccttcacgtcaatgcccacaatggtggcgtaagtggatctgtaacgccggttcctacccgcatacagggtcaggggtatattttccgctgttagttttggggtggctgcttccaccgactccatttcctttaaacgccggattgccttgttatccagctttgccgaacggctccctttacccgccggatatacgttgatgatggtaaggtcccccatctgggccagcatgctcttctgcgcctccttcattccgattccaatggatatcatgatgaccacggagcagcagcctatgatgactcccaatacggtgagaaaggtcctgctcttgtggcgggtcaggttctggatacatatggtgagtaagtcctttgttttcatgatctgtcttcctcgttttctgtaagccggtttccagaccgggcgtcctccggttcatcccagtcattccggttctggctgtcttccagcatatcccattcagtctgtccctggctcctgttccggacattcaatcccctggattttttcctctttatccacagaatccctgcaagcagcaccgcggtaagaataaccgccggcaatttccagtctggttttcttcctccgtccatttccccatccatcatatcagggccagccgtttcctcggcagcaccttcctttacctcgaatgtcacaggaatctccattgtccttacctccatggactcatcctcatatgtcacctttaccttgccctcaaaggttcctgcttttttcggggttgcgatgaaatcaatggtcccgctctttcctgcatcaaaattccccaggttcaggcttctgtcaataacctggatgtcgccttccagactggcctccacattgtacacctgtcccctgcccttgttcacataaggaagggagatggtggtctcctcattctggcggatttcttccacaaaagaaggcggacttacctggaaccggtcaggctggtaaaccggtactgcaatggtttcagtagcagtggactgctttctctccgtcttatcaatatactcatatttacacgatatggttatcttaggggactgtattttggaatcttttgtctggaacaatgcctggacatccacctgctgattttttctctcccccggccccatctttggaacataaaacgtgttggaggatgaattaatggatagcccttcccctgtttccagtgaaatgaccacattttcaatggtcgaaccctggctggtattcatgaattccatgttcagatgaaacacctgccctgctgagactttatctccatatgtataattagtcagtatgatattaggtgtgggggctcccggtgcggttgtcctgccattggtaggcaccacaatcctctcggagtatgtgccctggaccgttcccttatctgtatcatagtcaaacttcaatgtaactcccaaaagctgggatgcagcggatgacagctcggagcctgccttaaggttcacgggcacatccacggactgccccgggcctatatcccctatctgccgtgtatccgttgcctccaaaagggatatctggtcatttggttcaaaggtagctgtaagattccggatacctttggctgtgtcggtattttccatctttaataggatctggaacggctggccggaattaaccggacccatggggcctctgtctatccgcagtatgggctggcctgtggccgtgcctccttttacaggcagaagaaccttctgggcagaggtgaccggcgtcagttgtcctcctgaatagtagttgtactttaattctaaatcaatgagctggctggggccggatatatcctgtcccgcaatcaggttgaatttgacgttttcagtccttcccgtgtccaggcggctgacgattctggcgttggtatcatcgccaatgaacagggaggttcccggtgatacgtttaccaccatatcctcgatatccgcatctttgctggtgttctcaagttccacttccagggtgaagcggtctcctgggcctacagggttctgcggtgagattcgcctgacccttatgattggctgtcctgtggtgtttcctgtatccccgttttccctgggagcagactcctcgcattccgaaatgttcacctccagctgttccgggggaattcccgaacttttaaatcccaccttcagcctcaagacatctcccttccccgtgtatgtaagctttgaaaatgtaactgtaagctccaggtcatcctccttatccgatgtaatctttacctttggattttccccattccggaagctgtcgctcatcttggtcacggttaccccccgttttcccacctcgcttgtcttgattccattgcttcttaaattgaccaccacttttgcctgacgccctttgcgcagcacatccagggtgtcctttgaaccgcccagtgcaaaaatatcatatccgcccacccaaaggctgccgcttccagcttctccatcgtccggcttattggagccttccgtattgccgttgtttcccccgctgccgccctggttttctccgccctggcccgcaccgccggaatcagaacctgaaccgcccgtctccctgcctggctgaaatgttcctgcccctccggcttccattcctccggctcctgcccctccggcttccgttcctcctgctcctgcccctccgcccccatcccttccatctgtcccttctgcggcaatagcttcccgtattgccaggctgcccatctcctccgccatgacgctgccacacattcctattatcaaaatagctgcaatcgccacggccgctgctctttttatcattcttttcattattcctttcatctccatcgtcactgtcccttcctttcatctcccgttatgacgccatccaccagcgttacaatccggtctgcatacttggacatacccgggtcatgggtcaccagtatgatggtctggttgaatcttctggcaaatcccatgaccatgtccatgatctccgctgttgtctttgtgtccagattaccggtaggttcatctgcaaacaccacctcaggcctggatacaaatgccctggcaatccccgccctctgctgctgtcctccggacatctgggagggataatggtgaagtctgtgtgaaagtcctacacgtcttaacagatcttctgccatggcctcccgccgcttccggtccactcccttaaacataaggggcatggccacattttcaaccgctgtcatggacggcagcagattataggactgaaagataaagctcatatgctcctgacggaaggcggccagttcctcctcatccatacgggagatacttttcccgcggatgaacacctgcccttgcgtgggtttctccatcccggccagctggttcaaaagcgtgctctttccagaacccgacgtgccgaaaatacagcatacctctcctttgtagattttcagattaatccttttgagggctaccacttcctcgtcccccatccggtaaaccttgcgcacgttcttaacatatatgattggttttccatgttccatcatcttgtcactcctcttttcatgggtctatgataaaaaataatcccatggaaattgcatcatataaatcttaagaaatcttaatttcacaatacttaatttcacaataacctgtattttgggatggtcttttgctataatcattccatgttaaaggataactgcctgtaaaaagaaagaggtgagggaatgaagggcgcgattcttgaaaaaggtgaagcaggtcatacctatctgaaaaaactgttccagtcggttcaccatgtccagaaggactataactggctcatcacggactgtcagtgttgtacccgtaccgaagccttttaccagcggatatttcagtatgaccgatatggatggctttcaggcgaagaactgacctgcatggttgagacggaggatttccagtggatctgggctgtcctctccggttttcccagacatatatccctggctcaggtgctggaatatggcctgccttacgctgacatgtatcctggattctggaccaatcctgtctccatccagcatcccctggccgaggtggaaattgtttcctgggacagttcctgtacccttgtcataagccggaaccataagattgtatcggatttcatggatggatttccgcttagcagggatttgtccctgtataatggacaaaacggaatattggatgagacagatgaactggaacgctggttttcacagcacagatagaaaataccccaaatccttttacgcattggaatgggcatgatgtaagaaggaagccctgtttcggaagggatactgattgtggataaaatcccatttcagaaaagtgtcccctattggaatatgcatttggatgcgtacatttgggtacgtacatttgggtgcgtacattttagaacatacatttgtgaacatacagattggaccacaccggaggaaacggagggacaatcagttgcaccacgggagaactatcatgttttcatctatttgaacctgaagactacaggaatcaatatggaaaatcagcaaaaatatgaacctggttttcagaaaaaagtgactttaaaaaggggcatatgcttgaatggattgggagtaaaataagtattttcataaattaatccggcaggatgaagcatacatgcaatcccagcccatattacggaccatgtttccagcacagcataaaagccgccctccggcggcttctgtcaaataaaacattttcttacagcatttccctatatcaggtactcccccatggtctgataccccaatccctgcctgcccatgattcccatcatgttttcccgccatgacgggggcatgctccaggacaggccgcagccagcggatatctgccttggcaccggtatcaggcgtcccgggatatcctctttgcggcagactgtctccatggcgatggcctctgccgttgtatggaatgttatgaccagtctcagttcttttttcctcatatcctccaccccgtcttcccggtgccgggcggcgccggtactactcaatgatcagcctgtatccccgtccgtccggttccaccgtcacctttttaccctggctgattccatatttcctcacgttctcttttgtatggttttcgcttaccaggacctggattggtccgctgccatgggttttcagcgcattggctgtcagaaggacaggttccgggcaggataagcctcttgcatctacttcatacgccataatattgtcccctttcttatatctgttcttttcttggtacaaacccgattacaaacaggaccgcgatacatacgatgaccgctgcttttcccgcgccctgaagccctccggccactgccggggatgtctctgtggccgctgccgctgccgcggctgcaaatccaaagttatggcagcaggcagcccccacaaaaagccccaggaatgtcactgcggagtctgaggaaccctgccctgccagaatcagctgccttaaggggcatccccctgccaataccgctgcataccccactgcatacattccaagtatgttccacagatgctgggagtgcgccaccggctggccgtcaaaggacagcctgaagcctcctgacgccatgttatagataagcatgaccacaaaaaaaccgccaatgatggtaagcaggtcataattcctcatcaggaataaatccctgaaaccgcctgcaaagcaggtcctgcagcgctgtgacaccataccgaaagccagaccgcctgcaagggaaatcagtaccggagcgtgcatactgcccggtcccttctcactgaccgccatgactcctgtggcaacactggcaatcaaaaccaccaccaggaaggagggaaggatgtaaccgctgtaagccctagtctcataggcgcgcccaaggctgaatccccgctttaaagccacggtgcctgtgacagtcccaagcccgaaaccgatgagggccacatatgcattcaggtcgccggccgccatccggatgaccatcctcagggggcatcccaggaatgccagggaacctatcatcatgatgacccccagcaggaaccgtatcatgggtgaagaaccggccgtggagcggtattcccttgttgccatggataggatgaatgcccccagcacaatgcccacgatttccggcctcacatattgtacaaccgctgcctgatggaacttcatggcccccgccgtatcccgtatgaagcaggcaatacagattgccatatttctgggatttcccatcagtgccagcagcgccccaaccactcccagcactccgccatacatcatcagttttcttttggaatcaatattacccatagtgtgtatcccccctgtttttatgattgatatcttacattgatccagcaatttcccttaccgccagcacggcctggtccatctcttcctccgtgttataataggacatggagaaacggaccgctccctgccccacggttcccagcgcctggtgcatcaggggcgcacagtgggcccctgccctggtataaatcccataatccattgcaagtccatccgatacctcacccgaatcatagtcccggatattcaatgccaccaccggcgcgtgaaggtccatgtgggaaaaatccccgtatacggtgactcctgggatacccgaaaccccttggtagaaacgtcccatcagcatctgttccctgccgcggattgcctccatcccggtttcctttataaactccagggcagcatgaagccctgcaattccatgcccgttaaccgtgcctgcttccagtgcctccggcatgtctgtgggatgtatctccgaatagctgtgggtcccgcttccccctgccatcagaggacgtatggaaatgccttcccgtacacatatccccccagtcccctgtgggcccatcaggcttttgtgtccggtaaagcagagcacgtcaatacccatcttctccatgtctatgtcaaatacccctgctgtctgggatgcgtccagtatgaacaccagggatgccctccggcagatttcccccaccctggcaatatccaccaggttccccgtaaggttggatgcatgggtgcatatgattccctttgtgtttggccggatggctgcctccatgtcctcataccgtatgtttcccaggctgtcggccctgacaatggtcagttccacgccattttccctcatcatgtacaggggccggagcacggaattgtgttccagcatggtggtaatcacatggtcgcccggtgaaaagatgccccggacagccatgttcaggctggcggttgagttggcggtgaatgccacctgcaggggattgccaagaccgaacagttccgacacaagaacccttgtatcatatatggtcctggcagcacccagggatgcctgatggcttcccctgcctgaattccccatatggcgcatggcatcggccactgcctggatgaccgcctcaggcttatggtaagtggttgccccattatccagataaatcatttccctgtctcctttcgctgtgggcatccggtaaggttatgatatcaggacccgtttctcccccaccatcttcgttatctttttcttatccatgaattccagcatctgcaccgcgtatttacgggatgtgccgcacatatccctaaactcgcccagggatatctccccattctctgtcagataatccttcagccttgcaagtacctgtccataggcggcgctgtccatataggacgccgggttcagcttcaccagcttcccgttcttatgcatgtctgcaatgatctgctttgcccggttcttatccttgaactggttcaacacatccacggtaaggggcgcttcaatcccggcctgggcgtatatggtccctatctgctccagcatgccttttagctccctggaatactgggtggaaaaatccttgccggacacataggttccctgggtcctgaccaccatgcgtttgaccagctctgccagcagcacggcgcctttcctcatgtcgttcagccggaattcctcgctgagcctggacttgaattcctccttatccatgccttcgttgatggggttctccctgtgataaccggacagcagcctgtccgcatagtctgcgattgtcttccagtaatccatatggatgacggattcatcggatagtatgaggatgtgcttactgtcttttaaagtgctgatcatatggctggcccgggatttcggcatatccatatccgccgcaatccgtcccacggacgggaaacgcctgctttcttccttaatcataagctccatgacctcctggtccgtacctgtttcctttttatgcagggcttcgatggcctcctcatcccccctcctgtgtttataaggggatgcatccagcacgatgccgcctccgaatgtctccaccggtgaaaggaagcggatgatgaacctgtcattcctcttaagcaccacaggttcatcaaacctgatctgtgcataggcgctttccccatggccgatacggtccttatccatcaggactgcctttgcaatggtctgtgccgccccatagttgagatgaatcctgtccccggtcttaagttccctgtcactggtctggaaaatggacagtttcacatccaccagggtggatgtaacgagagaacctggaaatgcaagcacatcccctctttgcagttcctcttttttcacattcaggaggttcagggccgtgcgctgtcccgcatatgcggcgtcttcccgctggccgtgggactggattcccctgattttaatggggcgttcccggggatacagcatgacctcctgtcctgtctgcaccattccctcctgcagggttcccgtaatcacggttccaaatccttccgttgtgaacacccggtccacgggaaggcggaacagctccggctccgaactccggcttcccaggtctgagaccatccggatgattgtgtcatggagaagtccgatgttctcccctgtataggatgacacccggaggaccggggcatgttccaggaaacttccccggaccatatcctccacgtcggcctccaccatttcagcccattcctcatccaccatatcgctttttgtcagcaccaggattccctgtttgatgtgaagcattttcaatatctcaaaatgctccgtggtctggggcatgacaccctcgtccagtgcaatgaccatcagtaccaggtcgattcccccgatgcctgcaagcatgttcttaacgaacttctcatggcccggcacatcgatgatcccaatatgtagtccggcatcattgggcaggttggcaaatcccaggtcaatggtgattcccctctttttttcctccttcagcctgtctgtgtcaaaaccggaaagcgccttaatcaggcaggtctttccatggtccacatggccagccgtccccacaatgatattctgcattatatttcaccgcctttcatgtgaggaaatatctccgccccatggggcaatgtccctgcctcatggctcaatgtccctgcctcgtggctcaacgtccctgtcccatccgccggcgccccctctgccacggacagaaacgcctccactgccagaggaaattcctcatctgcaagggtcctcacatccaccagcaccctgtcatggttgacccgtacaatcagggggaccggggcctttctcagcttccgctccagcttctgggcgggcagttcctccttccatacgcctatcccatatccctccagttcacaggtaggcgcgcttcccccgcccacctggtccgtacaggattctatctcataatggaaatccgggcatgcggcttttagcatgtctgccagccgtccggccctttccttcagctcgtggggccgtgcgcatatcatcttaagcaccggtatttcctttaccgacgcctcccggtcaatgtactgtgcaaaagttgcctccagggctgccagggtcatcttatccacccggaatgcccttgcaagcgggtgcttcttcattctgtctatgtattcctttttcccgatgatgatacctgcctgcgggcctcctaacagcttgtcaccggagaacaggaccacatccgccccgtccttcagggcatctgtcactgttggctcatccagaccataccatctcagatccgtcatcagcccgctgcccatatcataaatcacaggaaggcccagttcctttcccagagccgacatctgcttaagccccacatcctccgtgaaccccacaatccggtaattggatgtatggaccttcatgaagcatccggtcaccccttcttcataggcgttccggtaatcggatatcctggtcttattggtggcccccacttccctgaggatggcgccggactcgcccatcacatcgggaatccggaaggagccgcccacttccaccagttcgcctcttgagacaaccacttccttccccctggccagggctgccaggaccagcatggtggctgccgcgttattgttcacagccatggctgcctcggcccctgtcaccttctttacaatgtcctccacaatcaggtggcggcttccccttgtccctgacttcaggtcgtattccagggtgcagtacgcatccatcacatccatcactgcctgggatgcctccctgctgagcctggcccgtcccagattggtatggagcactacccctgttgcattgaggacccttctcaatggctttttcttcttttccgtcagtatggcggttatcctgtccatgatttcatcctgggtcaggaccctgtcagccgtcccctccagaatggctgtcctcaaatcccccaccgcgtcccttactgtctccactatcaatggccttggcatggtttcataaaataaaacgaggcgcttatcctgcagcacctcgtccactttaggaagcccgcgcagaagcacatgtctgtcccccatcggtctacctccttagttgtaccggaacgcggactgtgtccagcccgtccgcggtacctgctgcataattagcaaaacggaggtggtgggaatcgaacccacccgtgaagctcttaactccacacaacggttttgaagaccgcggggcgcaccagctacccaacttcctcccaattataaagcgatactattcaattgtatgctttgacctggatgtgccacaccttagagcagggcacacccgaacggagatggtgggaatcgaacccacccgtgaagctcctaactccacacaacggttttgaagaccgcggggcgcaccagctacccaactttctccctaaaaacttaaatccatccataagctgcagcccatgggggatatggcaggcgggggggatgatatcctctcccccgcgcatcccataactaaaatcaatctatatatcctgcttccttcaatatacctgttgctttttccaggttggcctcggaaatctggacaattggtcctgtgcatcccatgccgctttccgcatagatgccttccttccataaggtcatcaccgcgtcatccaggtccatgacctcgatgcccgggatggccgctgtcaccacttccttgggcgggcaggccgctgcctctgcctcctcctgccttgccggggcgttcctggctaacagggcgtccaatccggcctttctggcagccgcatattccgcggcggcaaccgccttccaatcgcctgcaatcaggctggccgcatattccattgcccctgcaatcacaggcgcgccggaggccctggatacaatcatgaccagcttgtcatagccttcgccgatgcctggcccgtatccatatccggttgcctcatactggccgccggtggtgtaggaggaaaacatcttcatcatcaggttgccggtaagggagtccatcacaaccacatccgcagtacccatcagcaggtcgttgcccctcatctccacgcccttgtccgcccttgcggattgtgccagccggatgtcatatccattttccttcagggcctttaaaatcttctcacatgccctggccccgtctatgttggcaatccccacggtcggattttggatgccgtcagccttggctgcaatgattcctgcaatggcattcctgaccagggcagataccctgtccgtgtccgaggttcccgtggtattggcaatatacatgggctttccctttgcgggggtgattaccttgcccacggttgacacaccgatggggaatggatagtgcatggtcacggctgcctgggcatctcctgaggccagggcaagttccatggccttgtgggcatccgggccgtctaagaccgttaccccaatccccttcctggcagccaggttaagggccagatccgtgtcttcctgtccgtgctcgctgccctccagtgcgaataccaccttcgtgccgcagcaggacacagcccttgccaacgaggaatgtgtacgttccgccttttcgtttccggcctttacgtttccagccttttcgttcccagcctttccttccccggtttccacgtccccggcatttacccttccatccttcacgccttccgctgccccatccccctcgttggcttccaccacaaaggaaaccccgtcaaacaagttggtcatgcggcccaggaacagggaacccttgcccacaatcatggcgcgttttgtcctgccctccatgcattcctttacaagaggcccaagatacgggactccggatggaatatggccctgggtgggcgcccagccggtcattccgtgtttttttacaaaggacgggatatcggcccgttcaatctgctttttcatgacggccagagctgcaatcatcttataattggcttccggcacatcccctgctcccgctggtttggtgatgtccggattctgaagctccggcgcatacttatcgatatccgtgaatttaagccccgccttctcaaggggttccgccaccagggagctgatgaccatctgaggcgctgaaccggttccaatcttatggcagcccactatatccgttcgtatctggggatggatcccatcgtcctcagataccagtacggagaatcctgcaatgcaatcctccaggattggaagccctttcttcacatggtcctttccgttcattcccagcttggcggtacagcctccggccgtgacaatgacatttttaaatgtccctgatttgaccagggccgccgcatgtatcatggcatgggcaggtcctgcgcagaaaccgcgcacatcggagccggtggcgtttttatatcccgctatctcagccgatgccttggcaaagttgcctccgcccctctggttcatgtccccgcaggcttcctcgcagcagtcaatcacgtattccacatcatcgggattgaactcattcttaagtttaagttcaatcagggaaatgacgttggatgccttggacaccagattttcaagcatcacatgggcggacaggttcacatccacatcatgggcgcgctttacaacgcctgccagttcttccctgcggatataaagcccctcggaatgctcttcccttacaagccgttccagttcttccctggacccgttattcttaagaagcccttccagctgctcctgtgtgaacatcccgcgtttttccagcttatccttcacggtacgcgcaaagccttcctccagcatgaccagttcgaacacatcacagatgtgcatgaccccgtaaaattcatcttcagggaggatgcagccaaacggaccattttcctttggctccttccactttttatcataatatgggaacggtgtttctcccagttcctcatgggtcgcattccctatgtaaacctggttcgggatataggaaagcacatcctcatattccctcaggtgtcccggcagttccaccagatacccggagtccgggttcacaacccgctctgttgtctgtgtggtgccgttatatataaccatatccggggtggcagccaatgtatagctggtccccttaataaccggataacctttcattctgtatgtcccccaattttcatgaacaccgtgtgtacggtccggtctgtccctttctggattcctgtatcatacaggcgccttcgggacagccccgtccggatgggaacaggcccgggcagctaagctgcgcggcctggcctgttccgggtacgctcctgcaatcctcagtgaggccacgaatcaatatttgccgtagtccttgcggattttctccacttcctcatggattgccggaacatccataaccatttccatcattcccacctgttcatcataaacagcagggtctgcctctgcctttacttcatcttcgcaaatgtgatatacatttagtcccaactggactcctgctaaaggacctgcgtaagtggggtcgcctgccgtaacggtttcagcggccaggccggctgcttctgcttctgcagcacccagaagaacaacgatgttctccggtccgtattcctcacttaactttaaaacccttttctggttttccagatccatagcacccgcggacgttcagacaaagcattccgtagaggagtaggctatctttgcgccggctgtcttcgcacactcttctatggccggtcccggtacgccgtcacggtcaccgatgataatagcgtacttgtcttttaaaactgccatttcatttcctcctatttcattttatttatgcataagcctttgctggctttaagcatacttcttaatcatttcctcacaggaatcaggggttgcatcctccttcaccctggaatcaaccatcactccatccttatagatggcgatgaccggaagccccaggaccttctgggagatggcaagccttcttgcctttgtggtgtttaaggaacagaactttattgtcttgccgtacacctcttcaaatccatggatatggggcataagggctgcacagggcacacatccgtcgccgtaaaaatccaccaggatatatccttctgccttcagcacttcttcctcaaaattttcctttgtcaaatcggtcacgttcatatcctcctatttttcagattgtgttgtatttatcccgcctatatgttatcgcgataactttcgtctatattatacatgggagtccatacttaatcaagtacttttgcgtattttttactaactttcacccgtcactgcatatctgccacatagtgttcggcctgacatgcggctatggcgccgtcagccgcggccgtcaccacctggcgcagggatttcaccctcacgtcgccggccgcaaatactccttcgatattggtatgcatgtcttcatccgtcctgatgtacccgttttccatggccagcccgctgtcctccagaagtccggtgttgggcagatatccgatgaatccgaaaagcccgaacatcccgtcgtccgggtcggcaaggacctcggtgagctggcctgtcttcacattccgcaccaccatccggtcaaggatcccgtcaccgctaacctcgtccaccacactgtcccacatgaaatgcagcttctcattcctgaacgccttttcctggatggactgggcagccctcagctgatcccttctgtggattaccgtcaccttcctggcaaatttagtgagataaatggcttcctcaatggcggagtcaccgccgcccaccacatagacctccatatcctcgtagaaattggcgtcgcacgtggcacagaaggaaatgcctttgcccaggaagtccttttcattcctgcatccaatgggccttggatgggctcctgttgcaagaatcacggttttcccctcgtagacattgccctttgaatcaatcagcctctttaccggcccttcaagctccgtcttttcaatggccgcgctgaccctgtgcacaccgaatttctccacctgcttcgtcatacgcgcaatcagggttgccccggattcctccgcctcaaccatctggcccggataattctcaatgtccgatgtgatggcaatctgccccccgtcctggctcctctcaatcaaaagggtgttcagacggtacctgccgccgtaaaggcctgccgcaagacctgcggggcctgcgcccaggatgattaaatcatatatggttcccatttttccctgcctcctgaaacttaatgtaatcccggacaaatgtccttgacaaaatgccggaattgaatatgatagaaaatagcatctgccagcatctggcagataatacacaacataaggagtactgctcatgacagacattaaacttacagagctcaccggttcctgcggcggctgagcgtccaagatagggccagacaccctcgcgcaggtcctgcgcggtttaccaacctttcacgataaccggctgttagtgggctatgacactgcggatgatgccgctgtctatgaactttcccctgatatggccttaatccagaccgtggacatcttccccccggccgtggatgacccctacgaatacggcctgattgcagccgccaactcgttgtccgatgtatgggccatgggcggggaacccaggctgtgcatgaacatattgatgtttccggactccctccctcccgaagcggtcaacgccatactccgtggcgggtgcgataaggtggctgaggccggggccatcctggtaggcggccacaccctcaaggacgacattcccaagtatggcctttgcgtctcgggcctggtcccacccaaccgtatcctccgcaacaacacggtacgggaaggggatgtgctgatcctcacaaaacccctgggtaccggaatcctgacaaccgctgaccgcggcggccttttaacccgggcagaacaccaggccatggtaagatccatgaccacgctgaacaagtacgctgcggacgcggtgcgcagtcttgacggaatccatgcctgcacggatgtcactggtttttccctgctgggacacagcttcgagatgtgcgcgggcacaggacttaccgctgtcatagacagcgccagggtccccctgctccccggagcggacacctatgcgtccatggggctggttcctgccgcggcttaccagaacatgggacacctgaaggaaaaggtctcccttcccggcagcctcgcatcccacatccatgacctgctctttgaccctcagacttccgggggcctgctgtacagcgttgcccgtgcaaaagcaggacgcatcatggaagccatccttaaggcatgccctgaagctactgtcataggacatgtggaacgggattgcggttttccggtaactgtcctataacggtcatcctctgatccagtaaccggatccttatctgtaatgtacgggcagcatgcctgccctacatttccctgcagcagtccagcaggccgccaaggaagttcctgatccggatattgccgtgcttttcacttttcccccggatatagttcatctcctttttcatctgttcaaagctgtaaagccttcctgcgtattcattgaatacagggtccgcataatcatccaggcccctggcggccagattgtacatgccgtccgaggcagccctgcggatacgctgctccacgctcttggaattctgtttcatccttctgcacagttcccggattgtaatgtccccaaattccagttcctgttcaatcatatagctgatgatgcggatgatatccttgcttcccgcctcattcagtattccgatttcctggaggattcccttcagatgcctgacggaaagacttaagcttattcctccgtccgcctcccctggccggccgtcttccccgccagggtccggtgtgcccatgacgccgctcctggcctgtttaaggatccactgcatgttcttgaccatttccatactgcgcagggtgttcctgatttccgccatgttcaccggtttgtgcagcagcagttcagcacctccctcatacgccctctggacggtttccatatcatgggcctgtgacagcatgatgatggacgctgccggaagtgtctcctttatcctgcgtatgcatgtgacggccttaagttcaggaaggggtaaatccgccaggatcacatccggacggattccgggaatccgcctgcaggcatcgtcccagcctgccgatacgccggcaacctcccccagctcctccccttcaatcatatgggtcagttccctgcgcgagtagctgtcgcagtctataagatagattttcattttttatgtatgaacgtatcttttatattcttccacaacatgaataatatcaatacagcgcccacatatccattgagcacgtaaatcacattgaccaggaccctgaacgggaggaagagtcctaccagaagccccacaacgcctaaaataaccgttaggatcttaaaccgggctgtcccctctttggcaaacctggcgcatgggttatataaaagaggaaccgctgtcgtatagatgcctgcaaataccacaaccgcgaatatggaggcaaatggcttaaaaatccgttctgccaggatcaggttggggatatccgcattccacacaaagatcccgctgttgctgatgccggaggtattgatattggcaatctgagcaaacatgatcaggatgatggccacacacacagccagtgttcccagataaactccgtattccacatctttctttttattgttggcccccagggccgctgtaaagctggcaaaccacaaaagtacgaagcctgcgtaggacagactggaaatcatccagttaggccctgcgttcttgatggtttcaccgcccgcctgtgcaaaagcgccgctgtgtatgatatccagaccggcgttaatctgaccgccgtcccttaaaagggttaccacaccgattccgatacacagtacaacgatggccggtcctaccataccgatcttgtctaccagtgaattcagcccgcctaccacggtaaagatggccagggctgccaggatcacgcctcccaccacaaagggaaggccatactgctggttcagggtggatgccgctccacctaccatgacaaagaatgacatataacagaaaacagttgaataataatccatgaatgtcccaatgtattttccgcaataaaatttgtaaacgtcattccctttctcaaatctttcttctgcgcctgcctttgcaaaattgtaattgtagtatacaaagcagactgcaaatagtaataccgtcaggattccctgcactccgtatgcagtaaaatattgaatgatttcctgtcctgtggcaaatcctgagccgatggtaaatgcaatgactgcccccgcaagtatcattacccggccccagttaactttattatcattttccatatgccttctcctcttagcagacctggctgccgcaggggcacggcagtcccctggacacagccgctttggccgtgcccgggagcgtgtctgaacattgccttctgccacgctgcagcagccttcagcaattatttttcaaacactgtctgtccttccactggtgtctgcagggcttttaacgccctcctcaccatggataagcggagtttgtagctgtctgtctcaccctgtggcgggtcgcccagtgggtaggggatacctatgccagggatgatacggttggcaccgattgtcagggagataggaacaacggttgccatatgaactacaggaaggccatacttttcgatacctttaaccatcgttgcaccgcaacgagtacaggtccctcaggtggagacgaggatgaccccgtccacatgttcatcaacaaacatttttccaatctcggtcccgaacctggccgctgacgcggtcgctgtcccggtaccggtagtagcgcagaaatagttgacaagctcgccgaactcgccttccttttccagctctcttagcgcatcgaggggaaccaccacattggggtccgcgatggcaaactggcggtcatatccgccatggatggatgtaaaatcatcggctgaaagccggtccatacccgtaatatcgtatttgccccacttggtggcattactggattcgatatggtccgggttgcctgtgggcacgataccgcccgaggtgacaaccgcgattttggctttctttatatccttaatgggagcagcaggctcaacccggtcaaacttgggcatgggcaggtctgtctcaaatgcctcgccttttaatttcttgaccagcatctcaaccgcgcgctcagaacctctcttctcagcaaagtagttgacgcggattcctctttcaagatatccctcttcggaaggtcccagtatctcctgtccctcagccagcttcttaaccagggccgacatcacaggaagcaccttgggcatgcccgctgcggaattaggggttcccacaatgataaggtccttgcggaacatatccacgcccgggttctcctcatacattccggtgatgaccggtatcatgaggcgctcttccacggccttgcagatcgtgccgcaggccacgccgtaacgtcctgcgttaaatgcaggtcctgccacgaacacgtccggttcatacttcttcaccatctctatgacggcatcggttgccgcgtccaggttttccccaaaatagttgtcaccgcagataacggtggccgcaatttcataatcgcttcccagtgcggccctaagtcccatgcctggccccacggcgccttcacggacttccggcatatggtcggctttttcctcgccgccaataccggcaaagaactggttaatataatgtacgactttatatttcgccatgtttccatctcctttgattgatttagtatcctcttgctgccagcttgttaaagccattggcaatggtggaggctatgatgatctgaagctctgcctcaaagctgccgtccgggttcttacagccatcccagccgccaatctgcatctcgatgaactcctgggttccgatgaccttatccatggccgggaatataagggttgcattgccctgtccgcaggatgccagcgcatccgcttcctggcacacatccgccagggactgggacttgccgtccttgcccgggaactcatccgtaatcaggaccaccttggttcctgcattctccaccttgcggcagttcatcatcaggtccgtatcaggattgccatacccctcttccgtaatcaggacaccgtccagtcccatccagttacacagcttggcaaccatatcggaatggcgctccttgtcagcaaggaacacattctcattggtcaggatgacgcccatgaaattgatatccttgccatgatgcttatagcagtcctcaatgaccggattgtggaaatgatggtaggtggtaaccttgtcacagggcgccacgcagttgccggaaacaatggccccgtccatgatttctgtcggatacatgaaggtggggacgaactgcttggcatccacgccatagtaatatgtatcgtgaagaagtccctgggactgcagcatgtggatatatcccaccttgggaaggtccggatacatggccgcctgctcaaataccggtcttgtctcataggtgatgatctcgtccggctccaggtcccttccggcttccccgagataggccgctacctttaatccggccatgcgggccgccttctcgtacacatgggtctccaggccgtcggccggttccaccaccacgcacaggttattggtcttggagaacggacagtaatccgcggcaggaccgctcatatcgatcacgccttcctggaaccccacaatcttacctgctgtaatgacacagcagccctccagtgcatgggtccgtccactgcccacctgagggcttaccttcccgattacacctggaaaaatctctccgcctccgctgaccttgactcttggctcaatcacgtcctttaccggcgtgatcctcacggactcgcctggccttgcgatgtcaacatggcagccagccagcttgtcatcttccaggacaagcgtttcaacttcctctttgctgacataaaggaccccgtccttcacgtgagtcttgtcatcgaatcggatatcttttataaagatttttcccaattcaagcttcatatgaaatacctcccacttctttatattttactgccacccgccggcattacttcacccactccagcgaaatgacagcacttttacaattgacaatatttgttgtttgtgtaaaaatgatacttttaaaatagtaatcgcgataacttatggctataatatagcatatgttatcgcgattatcaatggttttaatgaagtcttttgttactttttgtaacattcacctttttcgtcattttgttatatttttgacattgtttttgtacatatttaccattggggctatttgggagtaaagtcactggcataaagctgggttatctccttgctctccgatatgaaccggtccaccagttccggtattgcctcaggttccaccccgtgctcctggacaaacttaaaatatcccagaaacagggtacagagaatgtgattcagctttcctgcattttcctctgtgattttcccctctttcacaagacgcctgcagatataatagtcgcggtcataataccctgggatttccagcatctcctttatcaggggactgacgcggatgatggcatccgggaacatttcataatattccttcagcgcctcccccaggtcccggttgatattgcggtagaacacggactcaaacgcttccggtttgcggaaagcctccgttgcataggaacgccatatgccgaaatgtacgtcccatatgtccttccattccttctcccggatggaaaggtccaggatatactcgttcagggcatccagctgcgcatagaacaaaagctcgtccaggttgtcaaagtaccggtacatgctggcggacgaacacccaagttccgttgccatgcggcgtatactgaccgcccccactccttcttccttgatgatcctgctggccaattccacataatcttttctgcttaagtccttaaaataggacgttcctgacttcttcatcatcgttcccccacgctctgctccctgtccatccctacagccttgggatgacattttcaatcatcgataagtcaatggtcttgtagtcataggctatcttcccatcatactcagggactttcttaatggcattccatttcccataggtttcaatggccttttctatgaggcacacatcctccccatccacggaccctgcttcgccgtacagcagtatggtcctgtagggcgtctggttgggctttaagctggacgcctggggatgggtcagaagcttatgccccctgtggattaaatccctggccttcttaagcacctcctcataggaatccagcatgaatacctggcccacgctttcctcccacttttttacagcccggtcattgttggtgaccaggatgcattttcctaaatcaaacattgtaatcccctcctttgtttttggactgcgcatgtaaatgcttttaatatcttacatcatattcgtggttcagtcaatttccccggcgggtttgtctgggctatattttcctagggcgtgtttgaaaattgctttccgtcagctgtgcgtcccactttgtgggagatttggtcccgatgatggaggcgtagcgggctacgctgactgaatcggggccaaatataccgcgaagtggggcgtgcagatggcgggaatgaattttcaaacaggccctagcagaaaggctgcgccggacctggaccgaagcagcctttgttgtatggatatttgtgttttagagcattcccagggctttgggcaggaaaagtgagatttgcgggaagaggcttaaaatcagaagggtaaataaaagcgcaccaatccatggaatcagcgcctttgtcagcctgatgattgatatgtccccaatccgtgaaatcacaaacagtaccattccaaaaggcggggtcagcaggccaatcataaggttcagaaccatcactaccccaaagtggaccggatttatccccattgcctgaatcagcggattcagtaatggcatcagtattgtaatggcggaaataggttccataaagcatcccacgattaacaggaacacattcagtatcagcatcataacaattggcgatgagatggaacctgtcaacagttccaaaagctgctggggtatctgggcccggatcaaaacattgccgtacagtgcagatgtggcaagtattaatccgatggtagcactgtccttcaccgtctcccttaacacatctgtcaattgcttcatgttcatttccttatatacaaataccgaaaggataaaggaatataccaccgccacaacagctgcttccgtagccgtaaaatatccgctgtaaatacctccgataatgataataggggtcatcagaggcaggattccctctttcaggctgataaagagcgcttttaccgtagggaaaggctccctgggataattattctttaccgcataaacagttaccacaaccatcataacagctgccattaaaagtccgggaagaatacctgccataaatagtgctccaactgaagccgaggccatcataccatataccaccataggaaggcttggtggtatgatgggaccaatggttgatgaagcagacgttactgcacaggcaaagtcagtatcaaagccatgatccttcatggccttaatctcaatggcccccaaaccacctgcatcggataccgcagtccctgacatacctgcaaaaataatactggataccacattcacatggccaagtccgccgggcaggaaaccaatgatgacctttgcgaagttaaacaggcggttggttatccctcccgtattcatcagctttccggccagcaggaatagcggaaccgccagcatggtaaatgagttgataccagaaactgtcatctgagccagtgtgttaatctgtatggtcccgtactgcatcagcataagtaccaccgccgtgattcccagactgaaggcaaccggaacgcctagtatgaacaagccaataagaagaaccagaaatacaatcccattcatctattaccaccttccttcccaaatgccagccccagacagcgtaccatatgggatatacagaaacaaaacatcatcaccccggaaaacagcactacaccatacaaataactgtgcttgaaccacatcagggaagccgctgcaacatcaccgctggtcttgatggtttcataggtaccccgcgaaaataaaagaaggaaaataccggatgccagatatgtaactgcctgaatcagatacctgaccctgggatgaaagcggtttaacagaacatcaatcataatatggttctcatctttagcagcaaggatggaacctaaaaatgttatataaacaaaggaaaacctggccatttcctcagtccatggggtcgcaatattaatcctcctgcatattacctgtaaaaatacaaacaataccatggccaccaccaggatgatagaaaggcagtcaattgccttatatagtaaattcaatgcttttctggccatcatgcacctcccttatgagaaatcccgttggcaaagccaacggtgacatcctattcagcataccccatcacttcatcataagtggttaccgtccacattgtctcaaataaatcctttaaaacgggttcagcagcagccctgaacgcatccacatccggttccactaccgtacagccgttatcaaccatctcctgaaggaactgtcctgataatatttccgcctgctcattggcatattccattgcctggtccgcacactcctggaaaagagcctttgtttcctcgtccatggcatcatactgtttcctgctgatataaatccaggtaggttcatagatatgatgtgtattaatcacatatttctgcacctcatacagcttgttggttgcaaactgctcataaggtccttcggacgcttctaccacattggtctgaagcgcactgtaaagctctgtcaatgcaacggaggtggtcagggcccccacccctttccaaaatgcaacccaggatgttatttctgacaccctgaacttgatattcttaaggtctgctggcgtctttatttccttattggcagttgtctccctgattcccctgcggttcatggccagggcatggatattattttcatccagctttttatacaggccttcaccgatttcacttccaagcacggcatccagatggtcccaatccttaatcatataaggagcagacaaaaactgatactccggcgcatacatatcaatgggttggattcctcctacaaccatgggaatctcgtctgctgccaaggcagtgaaattatccttctccgtacctaaagagccattggtaaatatattaatcttaatggccccactgctcttatcctcaatcagttctttgaatctggctgctccaagggctggcgctgactttgcatcataaacagttgccaggtcgatgttcatcttaggaaatgccgtctttgaatctgcatcccccgtttcatgattggctgctttcgtttcttttgacgctgcggccgtctccttgccccccgttgttgaactgctgcatcctgtaagcccgattgccatggaaactgcaagtcccaatgctattatacgtttcatactgcttcctcctttgaatgaaattattttataataccggtgtaaacggtatatctgcttaaaacatcttcatttatctcaatccccagcccggccccgtccggtacgtacacgcagttatcccggaagtcaaaaggctgcacaagaagttcatcccgaagcggattaaagttcctgtcatattccatagccggttcattctgcatcgccaccggattggctgtatggggtacgcaagccaaggatgcgattgctgataacgccactgccagggccacgcctgatccccatacatggggtacaaccataacaccataagaagtggcaaccgccacgatattcatgaattccgtcaaccctccgcatacacatatatccggttgggcaatgtcaatacatccttttccaataaaatccttaaacccatacctggtatattcgcattcgccgcctgcaatggcaacatccagggcctttctgactgcaatatatccctccctgtcctcaggcggcacaggttcttcgaaaaaatcaatcccctgttcttccagataacgccccatcttaatggctgaaaaactgttatatgcgtggttcgcatctacaaatatccttacatccttcccaactgcctcccggatagcccttaccctgagataatcctgttcaacaggaagaagccctactttaatcttcagcatctgaaacccctgcctgatgtaagatcgtgcctcctcctgaagttccttaagcttatccttcacatccagataatcctctccccgataataacatccggtagcatacgtcttaaccttatccctgaaacgtcctcctaataaactgctgaccggaagccccagcgcctttccgcaaatatcccacagcgcaatatctatagcactgattgcctctatgtatgatcccttctggccaaaatcccgtgtcaaagcatacatctggttccacaaaacccccttctcaaacggattcctgcctataagcagcggtgccagtatatgttccacacacgaacataccggttcagcagggccatactgccctccctctccccatccacatattccctcatctgtctctatcctgaccagaaaactattcctctccgggaattggcactgcgatgaaaagaatcttttctcccccaaaggaaccttcaatatataggttttaaccgctctgattttcatggccttctcctttcgtacaccaattgtatacaatcagtatacgatttaaaatataatttgtcaacactatctgtaaagattatatcaataatatttcagacctgaatttataaaggattttttaacatcctccatagtgctgaacaaatgcttccgcatcagttcctccgcctgtccggcatcccctgccttcatggcctcaagaatccttaaatgctcctcacaggactgtctgaatcttcctggtacattaatggaataattatgaagccactgattctgttcactgatattctttaaaatctgacgtatcctcctgttccctcctatctcaatggatatctggtgcagcttctggccttcctgaccaaactcctgcccatctccctgctggcatttctccattcccctgttaatgtcctcttcaatgacttttagattatcctgattgattatcctagtggcacaattaacacaatatccctccaagacagcccttactgtgtatatctcatcaatatcgttctccgaaagctgcctgacaaaacatccccggtaaggcatgataactacaaaattctcattctccagcctgcgcagcgcctgtctcaccggagtcctgctgacctcatacttctgggccagttcctcttctaccaacggtgcaccaaaatgcagacgcaggttaatgatctcattcttcagctcctcatatatgtaatctgaccgcccctgactgccctccttagatttctctttcacaatcattacctcctaataaacagttcgtatactattagtatacactatttctccgaatttggaagtacattactaaataaatcaccccccgccaattcaattgatgccagtgacccgtgaatcatcctgattccgggtcaccgccccacatcccaagttttatccaaaagcagcttatcgtcatctctctatatactggattgccacacaccgcggcccgccctgtgccacaaacacaggactcagctccagtatgtggatttccaagccgggaaacagttccgcaaacagttccttcatccggcgggcctcctctgccgctgctgcatgggatatatacaacaggtgccgctcccccagcttcttatcctgcagatatcggatgatgctgtccactgccccggacatggtccgctttaccccgtatttatccagcttcttcccgtccgcggtcagcttgacaatgggtttcagctttaagagggaacccacggcggctgccacgggcgtcagcctgccgccccgcctcaggaaggaaaagtcctggggtatcaggaaagattccgtcctgtctgccgccgccttaagccagtccaggatttcatccctggtccttccctcctctgccatcttcctggcctggtccaccatgtaacggtgggggccgcacaatgtcctgctattgaagacggtgatctgttcccggttttttgccatctccctggcgccttcagcactctgataggttccggacaggccgtcggccatggatatattgagaatgggctggtccttgtactgctcataggcatccaacacatcaccgatgggcggctgggatgaggtggggatctgcccagcctcaatccgcctgtaaaaatcctgcatatccatctgaaggtcccgcccgtggcagtccccaatgctgacacagagggggatggattcaatccctgcatcccgcccttccttaaccgtataaagtgttgatgaatctgtaatgatcttaaccatatcagtccccccggagttattatctggtattcaatactatgtattagagtttatagtattgatatgatatagtcaagacatatttcgacattttcctacattcctgctggcaaattatagcaatccattgtgcactgttttcagacaatctgctccaatatggatgggtcctttatcttcctgtcttctgccagcagcacgatcttggacatgatttccgctgtcttggggtcctcatccacaaacggaaggaagagcctgcccctggactggctgtggaccggaaggatgttgagcatggccccgcctgcctggtggatcacgccgctgcccagatggaccgtgtactctcccctggcgccttttatcattgcatggctgtcctttaatgtaacattggaaatgccaaagagaggcaggttgaattccacgattgccctgcgcatctctatggtggaatggctggtttccgggtccacgccgcctgcatgggccacgctgaccgccaggtccacatccctcatgacctcgctgtatataaggtccggtaccttgtcaatctcaagggattcaaaggttttccggtccgagaactccacccactccagggtgggcgcttccacatcactgggcgagaaccagtcggccagcgcgtatatcctggctatgatgtcctctttataatagaccttctgaagcccttcctcgtaatccgctatccagcgccttccacgcagcacagccacggtcttctgaggctggatctggttgcctgcaaacatcctggagtatttctgcccctgttcctcaggcagtttcacgtacagttccctgaatacctgcttaaagggctgtctgacgcagttgtcaaacagatatttctggtatccatgccatactccctggcggtataaatccaggggatgggcgatccgcagcaggtccgttcccttcagcggcgtacgtgtcccatcatagggcaccaggcaggggcttatattccccggctggccctgtgccgcatgttcctgcatttccatgaatcccagcttgccaccggacacaaacacaagcggcgccaatatggccctgaccaccgggtttgcataaagcatggacacctcatccacggtgaatagggtctggctttccatggattcctccatcattttcctggtcctggaatactggtccttcagctttttgtggacggccttgagttccatcacatatgcatccttacccagcctggaggggatggatttcagggccttgcccgggccaggtcccgtgatggcggacttacctgtatcagttcctggcgccgcggccttgcggcaaaggatttcactcttcccgtcctccctgatttccagtttcaccagtacatcgtccacctgtctccattccatgtattccctgaactgttccatgagccgtgtttccatgttaagggtcagccgggtcacatcctcaaatcccgcgttcacgcttaagttggtcagggctgtctccaccgcctttgcctcgctggcccgtctctgcgccccgaactggcggctttccttcaggaactgctggatatactggtagcggtctaccatgtcccggttcccgtcttccccaaagggaacaagccccagactcatcagcaggtccttgttgcgcctggcccctatctcatttttcagttcctccacacccacccgtccggcagcggcgtccgcgtacttcctggccctggaatgcttctgtccgtctgaaatatacttggccgcatcataaagcaggctgaaatgctcctctcccagctggccgtaggcttccctgaaccagttgacatcgaatgcgccgttctggagttcctccgggcttaagggggtgtattttgcaaaaatggccttcttcctgtcatcgaaattctcatccatatgggccatgaaataatagcatccgctttttaatcccctccagccaagatatccttctatgatatcaatccactggggcgcgtacatggccacctccaccagacggctttccttgatttccgtttccttcaggagctgtcccagggtctctggcgtatcgtcttctgccggataacaggattttaaaagcccgctgagcacttccttcttggtatatatccggctgcctccataccagccataataggaattccggtccagcgtgtcctttcccagggccatgaggatacggaccaggtaccgtgccccgcagatataggtgattcctcccatgaacctggaataacaggtttcgctgtccccgcggcgcagctccacatccaccatctgaggcacgattttgtcataaagctccttgcagagacggccttcttgcgtgtgctccagcatgtaggcattgcccttttcctgtatctggttataatatgcctcgccaaagaactggattgtgttccacctgttcctcgtcatggcgcattcgccgtggacgaactgggtcagcacctgaaggttcctggtggtatccaggtattcgaatactgcctttatcaggatatccatgggaatcatggacatgaggtacgccttcatgaaccaggacatgccaatgggtgtcattggctccctgcggtctgtgaggaactggccggtatctgaggtgtcacggcattttaactcaaaaccatatgcggtttcaaatgccagcctgaattcctggtctgtctgccagtacttaaggccctcaaagtaacggtcaaggagaggcaggcggttcatatagcaggaagtgtcatacatattattgttccatcccctgtactggtatgtaaccttcttgttcttctggtttaccactgcagacagggcctggatgactgccaggctctccttaaacaggctggccctgtccagataatccgtcctgtagttcaggcgtatggacctgacctggtccatatataccagggacaggggctccggtttaaacgggggctttccccaaacggcgcggtagaatacggctcctgcatcatacgcatggccctggatgaaaagcagggcttccatctccatcaggacctcatggcttttgatttcattttcatagaattccctgaattcctttgccagggggtaattctccagatgataggaatagtcctttgcatcctttaagaaatggtatccgttcccgagaagctgtgcctcgccgctcctgtcaaggtactcatagtccctatactgtccaaccaggctgtccagcttcttaaggatgaggatgacatccttttccttaaggggaaggcactgttccagtacctgagggtccggggttcccataggaagcgccgcgctggcggcagggtcgtacagaccatagccgttttcccgggatatatctgccttggtccctgcactgcctgtcagttcctctatgaggattttttccttgtccgtgggcgcttttatggcaaggggcagttccctcacttcctggtacagtttatccttatccttcatcctgctcaggcgcatcatcatgtccagggcggccgtgcgcttttcttcccttttgtcagacagaagacgggtcaccgaagcctttaaccatgcatcgtcctgttccatcaataggtcaatcagccttcccctcagcccgctgcgcttataccgcagcatatcctccaggatcatatagtccgcttcctcaagcttcagtttcattacgattgcataggccctttgggctgtgtattcttctgcattgcccacgtatcccagaaggatctccctctgcttccggttccctggttcatacaggagaaggttgatgagctggctcctgcaggaatacccgccctggctggtgatttcccctaaaaggcctgccatgtatgtaatcttctcctcgtcctgcaggatatacgccagaagggacagctgtccaaggaccattcccggacttaattccaccttataccacggaaagatgcaggggtcataaaccagtcccttctttggcatccttttataaatatccaggaacacggcatacagtgcccctgcttcttccctgctcccataaatatcatccggcacgggtttcctgggcgtcagcagctcccgcccgtaaaaggtccggtccgtgaacatcctggataaatcactgtgaaacctgcaggtaaatgcaggcatgaagcaggcagccagttccaggtcctccccctgttccaggagcacttttttcgccaccatgcttttataattgtcatcctgcagggactggttgtaatacgaagcggccagcttctgcggtttcgtgccatggtcaatgagcgccttcatggtatccatggcatcatatatttcccagaacccctttgcccacaatgccacgctgatggcaatggaatcattggatttaagctgtccgtcgcagaacctgctgtccctcagacagcttcccataagccccagaagcttaccgcttatgcggtccgcgctgttctcgtcaaatataccgatccaggtggatactgcccgcttaacagaggcaaaacggatcaggtcattgtcctctatgaccttcaggagaagcaggaatgcggggatggtaccttcatccatggactcgcagatggcctggcgcaggccttcctgtaaccttgcggccactaaaaggtctgccagcagcttatgaagcccttcgttatctgagcggaggattccaagtatcatctggcggtccaggtaagccgtgttattatcgctgaggatcagttccttcagggtatctatgaccttctggttcccacggtcgatttcagctgcatataccaggtcaaatccattcatgaaacaggactccgactttatgtagtccagcatctccggctccagctgtcttaacatcagacggctgatgtccccgccgcagtagaaaatccgttcatatgtattaagaagcccaatggcacggcgcatctgcggcccgtacccccgggtacgcaccgtcctgcggctatatcccgtggaataggggaaccggttcagtttatcaatgatgtagagataggaatcctggtaatcctttggcacaaacgcgtccagaatccctccatgggccctcttttgcaatatcagccccttcttttcaaaccactggctgggctttttatcaccggcagcgtaatactcacttactgcactgtcaaccatcgggatattaccattcctgtatcccctgcttaaggactttatctcctctgccagcttcttctcatcccccttaagtttcccggtcctggcatccagcttgctgtccctcagctccgtaatcttccttctggtgttgtaatcataatcagccatctcaccacatccttcccgccagcatggtcagcctgacaaatgtaaggctgctcccttctgtcagcaatatcttctcttccagttgttcaagcgccctgtcatccaggaaaatcctgtatataccgtcctcaaaggactggattgcatgatccaccgccgattccaggtcagccttcctgtccccgtaattcacgccaaagcccaccttgccggaagctgcctggtcattaatctcatcgctggtcaggcagcgcagcagctccttatcatccatcctctggttatagagcgctacacatgcagtggtcatggcttctatcagttccctgacgttccccggatgtccgggaatctcatatacggcttcctggacctggtgtttgctttttcctatctttttgatgttgaccttcagcttcacggatattcctccccgattttttcttcttctgacccaccggatgattcagtgcatcagcttcaatcatacagtctattctaccatataatcccagtccataccactccatttgcggccctcagacaggctggtcagctcccggccacagttcccgattacagcttccggttacaactcccggtcacagttccctcccattggtctcaattaccctgcggtaccagtaaaagctgtcctttttaatgcgcgccaggtcctttaagtcatgttcatcccggttcacatacacaaaaccataccgtttccggaagccctgatgggaactgagcaggtccataaaagaccagggggaatatccgaacagatccacgccgtccccaatggcctgggaacatgcctcaatatgctgtctgagatagtctatcctgtagtagtcgtggaccttgccgttttccgtgagcacgtccccggccccaagaccattttccgtgacaatgaggggaagcctgtatctgcggtagtacagattgagcaccgtcctgagccccatggggtcaatctgcgcgccgtatgcgctggtttccagatattcattcttaacatgccggaaatatccatactggtcaaaatccacctcgttgactggaaatgaccgttccccaagcacatgccccccggttgccggaagatatgaaacgcaaagcgtcctgtaatagttgacagcaatataatccatccgcgcgcccatcagtatctccctgtccccagcccccgtctttggcacaatgccccgctcctctaaatacctcatataatatcccggatattcaccgtcatagtacatgtccagacaataatccgtcttgaaccagtcattcatcctggcagcccatacgtcctccggccggttggtcaggggataggtgcaggtggaggaaaccgccgggcctattcttcccccgggaaccaattcatggcacgcctttacggcaagggcatgggccaggaacatgtgataatccatctgcgccctgaggcggtcgcactcccacgcatccccggccttgatattcatccgttcatccaccctgaccatcaggttctgctcattgtggacctgccagtacgccaccttgtccccaaattcacggaatacgattccggcataccgctcaaaggcagccacacattccctggattcccagccattgtacttttccaccagggcataggggaggtcaaagtgatacagggtcacaaagggttgaatgccctgttccaaaagacagtcaatgacctgatggtagaacctgattccttcctgattcacatccccgtccccatccggtatgatcctggcccaggacatggaaaaacggtacatcttaagccccagttccttcatcagcccgatatcctccctccagcggtgataaaaatcactggccgtcctggtgtctgcctggatgccggaacgccggaaggaattgtaatccgccacggtcatgcctttcttcccctcatcccatccgccctctatctggaatgcggaggaggatgcgccccagaggaaatgttccgggaatagggttggtcgtctgacggaacctgctgtttcatccgtgccttttttactcatggaatcctccttttcattgttctcatcctctattgtcttcatcctccatcgtcctcatcctctattctccccttcatccaattcctcaaacccaaacacccaggtcagcaatgccgacccaaaaaaggaaatactgattcccagcagataaaagaggaaattcctcattccgaacgccccataggttgccagcgtaagcacgccattatttgcaaatgcatccccatacacgccgccaatccccatgaccgcccctcccgccgccccgcagataacggcgcataccatgggcttcttaagccgtaagttgcagccataaatcgcaggctccgtaatcccgcacaccccggcggtcagggaggcggaggcggcaattgctttcaggttcctgtcctttgtcctcagcatcacccccagggcagcgccgccctgggaaaagttagccgcccctgcaaatgccagcaggttctgccgtccaaaccgcgccacatcattaatcccaatggggaccagggcgcggtgggcgccgaatatgacgaacacacaccacatcccgccgatgaaagccccgcatagggccgggcttaaggccatcatgcccgtatacacgtaattgattgcatttccaatgtaaatgcccaccgggccaaataccagatagacggcaggcaccatgaccagcagggaaatgcccggcaccaggatgattttcaatatctcaggaatgaccctggtcaggaaccgttccacataggacagtatgaataccccgatgatgatagggatgaccgaggacgtatagttggcctttgtaagtgcgatgccaaacatcctgaccgccgccccgcccgtcatcagttccagtatgaccggatagcacatggtgccgcccaatgccatggcaacgaattcattgccatgaaatacctttgcgctggtatatgcaaggatgatcggcatgaaataaaagattgcatccgtggcagccatcaggatgatgtaagtctcattccccgtaatgtccactccgcggccggaggcagtaatcctggcaatggtcaggaatccttttaagagcccggaggctgcaatagcaggcaccatgggggtgaacatggcggatatggatatcaggatgcggttccatacggaggtaccctgcctggcgcctgcctggatgtccttattggcggctggtgtctttcctgtcgatatctttcccgccgatgtttttcctgccgatatttctcctgctgacgccctttctgacgatgtctttcccgcctccatctgcctgcataccgcctcatagacatgttccacttttgtcccaatcaccacctgcatctgtccgccccgttccaccacggaaaccacgccctccacctgtgcaagcttttctttgtctgctttcgtcctgtccgacagttcaaacctaagcctggtaaagcagtgtgtaagattctccacattcccgggaccgcctgccagggtcaggatgtccctggccaccgcatcataattcatatttcctgctccttcccgctgcctgcatttccctgaaaacagcacaaaaaagccgggttcatctgcaggcaggaccatataggtttaatatagcatttacctgcggatttcatccggctattttaggggtctgctgcccttctctgttttttgtatttaccatccgttgactgcatagagaactgccaggcggagctgtctcaggagtccgtcagacaaggttccatattcttcgtccatccctttttcatgggccatgtagggcggggaatcattccacgaacccatggcgccgaacacatccgcccggctggcagcctggaagaggggcagatggctttccggaatctgagggaggggaatctgtccggacctatgttccggaagtgaaaccccctgcaggtacgacagggatgtttcgaatatatccgcaaaattaccgcaatcaatttctcgggcaaaccgccctatcttttccaggattgctttaaaatcctccgtgttatcgccaaaatggaacttcatcccggacaggtccttacagacctgttccgcgtaccggatatcccagcccttttgcgcggaatcgaactcccatcttggaaagaaaaggcttacctggctgttcccccaaaaacagacaagggcgctctgggacgtgttggaaaatcccagcacattccggtccttgacctggatgggaagcatcatcttgatatccctcatgcccttcttacagcagtggacataccactcctccacccccttggcatttacctgctttgtgccaaacagcttcttttccggcaggaactggaatccgatgcatttttcatatggcacaggctcatattgtatggatgcgcctgtcttaagcgcgtttttggctgccgctgtgatgtggcagatctgatacatttccccgttcatggaaataatcctcctgatactgatggcttacagtctgttaaaactggtttcatcatagcacaggtccggctggatttccactatatacggagcagggctgccataatacctgacagtatattttaatttgcccggatggaacagggatggtataatgaactggtaaataatgtaattcctgacaagtcaaaggaggaccggggatgaaaaaaatgacaggtttgaaacagggtatgctctatttaatatgcgcggcagtcatcataagcagtccgtccaccgtatctgccggcaatggacagactgatgtggaagataccggtgagcagccgccatcgcttcgaaaagagattcagaaactgaaaaagggaaactgggttaacctgaccacgcagcagaagctggaggatctggatatcctgtatcagaccctgaaggataattatccttatttccatgtcctcaggagaatgcggaatgtggatctggaggaaaaataccggacagcaagaaaagaaatcagcaggggcggaaccgatatcgccttttatcagcagctggatgcattcattaataccaatgaccagattggacatctgatgctggacaatccctactggtatgaagattccgccagttcctacaaaagccttgccagggattatcctgaaatggaacgcatgcagaaattctccgcagcatacaacaatgataaatccatggaaaactacgggaaaatgaaggccataacaaatcctgcctataacaaagtgatggcatattacgatgccgctgaaacagcccaggatacaggaacggaatcagcggcggataatgtccggacacacatcgataatgtccagacacgcatcattcaagaaggccgtattgcctacataaaaatcgattcccttctaccctccaatgtctacggcgaggataaaaaacagctctttgatttttatggaaccgtgaaggattatgataacgtgatattcgatttcacggataatggcggcggttccatgaattatttcaatgacctgattgtatcccccaatattgataccaccctgaaatacaacgcgtataaactgataaaagccggggaaaataacgggattttcctggatttcaatgattaccgccctatttcggaattccccggacttcccctcatgaatcaggatgacctgtccgatgtggatctgttccatgaaatagagtacacaaccgaacctttggggaaagaaaaaatgctgaaaggaaaactatggctgcttgtaagcgataccgtcttttcctcgtccgaatacgcagccatgttttccaaggcaaccggcttcatgacgctggtgggaaccaggacaggcggggaaggaatcggaagcgaccctctgcccatcatacttccaaacagcggtcttatcgttcagtacgcagcagagtacggcgctttgcccgatggttccggcagccaggagtatgggacaatgcctgatatcctctctcctgagggggagtccgcgctggatacctgtttaagggtcattggacaggatcactagccatgatatgtgctgatatggctctgtctgtattgacacatggactacatcgtgttatcatatatttagactacacattgtagttttaacaggaggaaggaacgaatggtccaacaggtatctgatgctgaattagaactgatgaaaatcatctgggcaaagggcggcagggtcctttatgcccaaatcatggatgagcttgcagcggctggcagccgctggcaaaagaacacggtcatcaccctgctgtcccgtctggtggaaaaggggcttttaaagacaaataagataggccgccgtaacgaatacgccgccctggttacagaggcagattaccaggcgctgcagacagaaaagctgattaaaaaattctacgagggcaatgcaaagggacttgtatcaacattaatccaaagggatatgctgacagctgaggactatgaggagttgaggcaattctgggaggaggagaacaagagccgatgaatggaatatggaaagtcatcctgtccatgtcgctttccgggaccttactgattaccgccctgctcctctttaaacccttgttcaggaaccggtttggcagacgttggcagtactatatctggctggtggtaatcagccgtctgctcctgccattcacaccgcaagaaagcctcatgaacaccttattcttaaaggccgggcaggcaggtatccaggcggggacagccttagttgaggaacagatgaccgggttgatgctggctggaggcgctatgggggacggtgctgccggcaatgacagtacggacggtggcactttatggaatgatattgtggagaatagggctgacggtaatggctccgctgataagagcgttgttcataagggcgctgttcataagggctccgctgataagggtgctgttgataagggtgctgttgataagggcgccgctgataagggcgctgttgataagggcgctgttgataagggcgctgttgataagggcgttacagggcgtgaaaatgaaacctcaaaatccaggacaggcttatcccccgctgtcctgacagcaggaaagcttctatcccatctctcccaaaacctctggcttatctggctcatgacagcaataatcctgctgacacggaagattacagcttatcaggacttcagggattacgtaaaagctggcggggaagcggttgctgatacaaggatattagaccggatggcagtgattggcggacaggccggaatcaggaaacctgtggaactgtacattaatcctcttgtttcctccccgcttctgatgggccttttccatccctgtatcgtgctccctgaggctgacatgcaggagactggatttgactgcatcctgctccacgaactgacccacttaagacggatggataccgtttacaaatggctggtccagtttacaatctgcctgcattggttcaatccacttgtgcatctgatgggccgtgaaatcagccgggcctgtgaacttgcctgcgacgaggcggtcatcatgaaactggacagggaaaagatacgggtctacggtgatacactgatccatgccacaggcgccggaggcatctgtaaagcgcctctctcctccgtgacactgattgaaggcaaggaactgttaaaagaaaggttgggcgcaattatgacatttaagaaaaaaacaaggtttgccgctgtcactgcttttgccatgacactcttattatcagccggcgcgattacaacgggagcctatgctgcttcccatgcatccattagcggcagccaatccatatcagaccttagggaattcctgaaccgaagcctgtatcacaatttccatgctgcaacaaccgaggatgaaaaaaattatgaaatcagcggtacaatctatcagaacacccatccacggagcctggtccgttttgaaaagctgccggataccgggcttacggtaagcggaagcataaccccactggatggggagatacggctgatgtacagggatgaggatggtacgctggtcacactggccgatgaaacagcaggcgccggggaggctgttcctgtttcctgcagcatcaatgtttctgaaaaaggtgaattctattttgagtctgattctgccatctgtgaatttgacctgttattctctaaatcagatggaaccgtatattatcttacgaatgaaaacccaattggacttacatattaagggatattggaaatgatgcgcgtttacagtgtatcgattccaagtaaattcttagccagtatgccaataataaacgaaataacagcaactgacaaagatatcagggccatttccagaaaccgtctgaggaatggctcttcctttgccacggatatgtaatagttgaaaaacagtatgataagcatgacggtcacaatcattaccgcaaatgcagcaacatacatatgggccggaaataagagatagggaagcaccagcagggccacggtcaccagatatgccgcccctgtataggcactggacttcaacgcctctgcattcccctctgcccgctccgccagatagttggaagccgccatggacagggttgcggaaattcccgttatgattccggtcatggctaccaggcgcgtattggcaagggcaaaggtaacgcctgcaatggcgcccgtaagttcaaccaaggcgtcattcagccccaaaaccatggcgcccacgtagtgaaggcgttcctcatccagcatattgtatagtatattctcatgggaccgctcctcctccagcatcctggctgcctggggcagttcatggcacatcattccataccgttcccgtcccacccgctcatccttctgcatcatctttaccacgaatgtgaatccgaagataacggtcagtatctttaggaacaggatatggcttcttttagggaccacatcttcccctgtgattcctttccatacagctgcgtgcgccttttcatccgaggacatctggctgaacaccttcctgtttttttcatccttctgtttcctccccagatatccataaagaatggccccggtctcctcgtcaatctgcgccttgcgcacggtttccttcatttccggacttaatgtcatgtctttcatcctatgtccccccattatctttcctttcaccgccttctgatttaccctggacttccctctgacaggccttatagtgtgtttgaaaattcattcccgccatctgcacaccccactccatcttctcctgacattcactgcattccctgtcatgaagggaaataatgcctttgcaccgcttacacgtatatcttttcttctgctcttccatgaaggattcaaggccatggtcctgaacatgcctgctgttttccataaggcttgcctggtatcgcctgttatagcttttctcaagattcctgatctgtctgcacggatattcagggcattgaaaacagtaggataatccttttcctctgacgcagtcttttatgtcacaggccctgcagtgttccggctttcccaagtcactttccaggcagcctgcgcatggtttcctgtggtaacagtgcctgtaacagaccatgcagttcattccgcatggagcaaacatgaccgggcggatgccttcctcaggcattttcataagcctcttccctcccctccatggaaatcctatgcctcctgctgtacatccctcttcctgacggtcgggtaattctcaatgatatccctgtatctgaagcagccttccccatgatcattgatgaccccgcaggcctgcagatgggagtacacggtgattgaacccatatacttgaatccccgcttctttaaatccctgctcacctcatccgacagcttgttgcttgccgggatccggcccttctgatgccccgcatacaggatggtctttcccttggaaaaagaccatatataccggctgaaggagccgtattcctccctgatttcccggaaacgccgggcgttatggatgacggcctccacttttcgcctggaacggatcattccttccgccacaaggatacgctccacgtccctatccccgtaagcagccaccttatcatagtcaaacccgtcaaaacactgacggaagatttcccgtttctgaatcatcatgttccagttcaggccgcactgcatgacctccatcatgagaaattcaaattgcctgtaatcatcatggagggggatgccccactcctcatcgtggtatctgatcattttttcattgcaaaggcaccatggacagcgttccatacaatcttccccctctggtttatggtttatctccggtctggttttatgtacacaactaccttttcattatatcgtcatacctgcaataatacaagaaaacagcgcattaaaagacagcggaaatgaaggcagggagccttcttccaatcagctccctgcctctgttctttttaaccatctgaatccatgaccgtccacctttacagcggacgcccgcagtatttccccggtcatcatatcctggtacatgccgtctgtctcatcaatccaggcaatcttcccatagtcatgaaaattaaagatacctaccagctttccctgttcccgttcccgcaccaggcacagcacggaatcatcccaggtttccctgacagagaacctggcgtccgcaccaaaaagttcctcgcccctgcgcagttcctccagctgttttagcccggaaaatatccgtccctgcacggaattgccgtcttttatgtatcctgtcagttcccaccggaattttcccctgtggatatagcgggaatcagcggctttctcaggatcctccttgtacgtgtagtcatttacctgccctatctcatccccgctgtaaaggacaggtatcccggacaggaagaagaggaatccatggaggcacaggatacgcccgattccatgttccatgccttcatcgtccatttcaaaaccagccttttccactccgcacatggaggccgttgttccgcagaaccgcgcatcgcctgtgacaggatcttcgttgtacagttcgccccggctgaagctttccggtatctttcctgtgaagaagtcattgaggtatttcttatgtggcacctgcttcatgccccaggattccagaagcggatagtccagcccccagccaatatcgtcatggcaccggagataattgaggaaggaacaggtgtccggcagcctgctgatggtttccatctggcgttttaaaagcctggcgtccctggcggcaaccgaatgccacagggtggccatggtggttacattgtaaagcatatggcactcaggtttttccaccgtgccaaagtacggcgccaccttttccggctccatgaccacttctcccagaagcagtacgccggggcacacaatctcgccgatcatacgcatcatgcgcacaatggtgtggacctggggaaggttcctgcagtccgttcccagttctttccagatatatggcaccgcatctatccgtatgacatccatcccgcagttggccaggtacaggaaattatacatcatctcgttaaacaccacgggattcctgtaattcagatcccactgatagggataaaagctggtcatcacgtagctgcctgtttccggaaggtaggtgaagttgcccggcgccgtggcggggaatacctggggtacggtctgttcatattgcctgggaatgtcataggagtcatagaaaaagtaccgttccctgtactccttttcacctgccctggcccgctttgcccattcatgttcctcggacgtgtggttcatcacaaaatccaggcacaggctgattccccgtttatggcactcatctgccagcgtcatcaaatcgtccatggttccaaggtcatcccttaccttcctgaaatccgacaccgcatatcctccgtctgaacggcccctgggggtgtccagcaaaggcatcagatgtagataattgacattacagccttctatgtaatccagcttctccttcacgcctgttaacgtgcctgcaaactggtccgtgtacatcatcatgccaagcatgctgcttttcctgaaccatcccggattcttctcccgctccatgtccagccttttaaggctgtccctgcgctccagacagaactgctccattcccctgcacagcccttcaaacatctgctgattgtcgtaaagctccatataaagccatttcagttcatccagatggcgctccaggcgtttctggaaaggggggatttttaatccggcttttcctgctatgggtctgtctgctgtatgcttgtctgctgtgtttttatctgccgaatgccgacctgttatgtttttatctgccgcatgttggcctgctatgtttttatctgccgcatgccggcctgttatgtttttatctgccgcatgccggcctgttatgcttttatccgccgcatgccggcctgttatgtttttatccgccgcatgacggcctgttatgcttttatccgccgcatgacggcctgttatgcttttatccgccacatgctgtcctgttatgtttttatctgtcacacatttacccgcttctgccctatacgctccatttttatcagatttatcagccatcttcaattctcctgttcccgcattcctgccgtgccttatcccgccgtaccggaatcacacctttaccagatgcgcctgccatgactggtattcatcggtcatataaggtatcggaagcccggcggacataagggccgcccccggatatacgcggcccgtggacccttcccggtagctccacccaggttccagtcctttcagccgtatgtacacaggaagcgggttgccatgtgtctcaagggtcactgcattcaccagtgcctcgcttttatcttccctgacaaacatccatgcccctgcctgcatttccttaaatggattgccaagcctgtagtaatcgccgttgtggattaaatcctgatacctgtgataatcctcaatctgtttcctgatgcattccttctcatcctgcgtcagtacgcccggatccagttcgtacccaaagctgcccgccatggccactacgccccgggtttccagggaaacctgccttccggtctggtggttggggcatgcggatacatgggagccaacggatgatatgggaaaaccaaaggatgtgccgtactggatacggatgcggtcaatggcatccgtgttgtcgctgcaccatatctggggcgtatagtagagcatacctgcgtcaaaccgtccgccaccgccgctgcatccttcaatcagcatatccggataccgctttgtaagacgttccaggaaatcgtataatcccagcacgtagtggtacatgacctttcccgggttcacggtcctggcggcccggacgttcccgccatcctgtgtattcccaccattttgcaggttagcgccgtcccgttcctgcaccgcagagtatacatccgtgatgctgcggttcatatcccatttcacatattcaatattggcgctgtcaaatacccggcagatgctgtcaaacacataatccaccacttccttccgggagaaatccagtaccagctggctccggctcatcaccggcttccttccgggaatggtaaacgcccagtcaggatgggcccggtatagattgctgtcaagggataccatttccggttcaatccatatcccgaacttaagtcccaggccgttcacccgctccaccaggctgcccagggtgccgcccagcttgccttcattgacagaccagtccccaaggcccgacgtatcgctgtcccgtctgccaaaccagccgtcatccagcaccagcagctccacgcccagttccccggcctgtctggctgtctcatatatggtttcccctgtaaagtcaaaataagccgcttcccagccgttaatcagcaccggtctgggggccagcttgtatttccccctgcacaggttgcggcggatggctttgtggaaatgctgcgacagggcggacagcccgcttccgctgtaactcatgatgacctccggcccaaggaaggtatcccccggatccagtccataggagaacatctcgtcctgaagccccatcatcatcctggtctggccaaactggtccttttccacctctgccctgaatgctccgctgtagacaaatgacatgccgtagcatttccccgcatcctccgtggcatccctttcagccagtatcacaaaggggctgtactggtggctggaggtcccgcgcctgcttccgatcacatgggcgccatgggatacctctgtcctctgccagttccgttccatggcatgcctgccgtaaaactgtatccagtcatagtccccgtaaaggaaatccaggcacgcgctctgcaccttttcaagggccagggatccatttcccatgttctcaatctttacagccctggttatgatatcgtggattggaaataccccgtataataatgtcaccataagcccactggccctgtcctcaaggacgatttccaatgtttcgcaatccatttccgcgccgccgtctgcaggctgcccggccgccgccttatccgcgccgcccgtttcctcctggtacatggccggaagtcccggcagactgtatttcccctgctttatggcatggctgcggtagcgcaggtcacagctcatggaaccgtccgcctgccttacctgcaaggccgtgctcctgtaatccccggtaccaaggaccggatattcctgggggagtacgtccagggaataggtcctgtccccgccggactcatagggatttcctgaaaatcccctgtccgcataggtgagaaggtattccatggagccttctgagcggtccccgtaataaagatgcagcaggtacccaaagcggtccaccttcatctgataggtcgattgtcttgtgtgtatggtgaatagctgttgttcttcctggtaacggattgccattgtctgtctccttttaaatgttctattttccgcctgtcatggcaatgccctcaatgaactgcttctggaacaccaggtacaggatgaccatgggtatcatggccagcatggaacctgccatcaggaccggatagttggtggtgaactgccccctcagtgtggaaaggcctgccgacagcgtcatcatgttgatatccgtgttggcaatcagcggccacatcaggtcggcataggcaaacactgcggtgaagatggtcagggctgccatggaagccttggtcaggggcatcattacccttgtaaatgtctgccatttggtgcatccgtccaggtaggcggcttcacccagctcatcggggatacccatgtaagcctggcgcaggaagaatgttccgaaggcgctgaccagccccgggaataccagtgcaaatatcgtgttggtcagtcccatcttcgccagcatctgatactgggggatgatgaatatctgtgatggcagcatcatctgcatgatgaccagtgagaacagcaggttctttcccctgaacttaagcttggcaaatgcaaacccggctgcggatgagaatgccactgcgcagattaccctgaaaagaatcagcaggacggtgttggtatacagttttacgaaagggagggcaatcaatgccctgttatagttttctgcaagccattccttcggaaggatcgtgggcggtatctgcacgctttcaccggctgatttaaagctggtaagaagcatccacaaaaaagggaatatcatcagcacggcccctgcccccagcacggcatatacgagtatggtattaatcttacggctttcttggtatgatttcatggaatctcctccttatttatctcctggggcgtgtttgaaaacccatccccgccatctgcacaccctaaacctcatagttgacccattttttctgtccccagaactgcagggccgtgatgatgccgattaatgccacggtccagatcacgattgccgaagcataccccctgttccctgccacaaaggattcccggtagaacaggtacataagggactgggcgctggtcagggccggattggtctggtccaccatcatgtaaatcaggtcgtaaaccttgatggaggccatcagacgcatgattaataccacaaacaaggtagggctgaccatgggcagggtaatcttgaaaaactgctgtatcttcgttgccccgtccaggctggccgcctcataatagcttttggaaatgttctggatcccggacagcagcaggatggcgtcgtatccgatggcgctccagatagccaccacggcgcaggcaggcagcaccaggccgggcgtggtaagccagctcacctttgttccgattatctggttgatgattccgtattccgcgttgaagatccatttccacaccattgcgatggctgccggggccactaccatgggaaggaagtagatggccctgaaggcggattttcccttaatctttgcattcagcagcacggctgcaagcagggacaggaacacgccaagaggcacggtcaggatacagaaatagatggagttccatgttgctttccagaattccttacttgcaaacatctgctcataattctggattcccgtgacttcataaatcccaaaggggtgggtggtggaaaaactcagcaccagggtctggatgaaaggatatacatttaatacaatcagtcctatgatggtgggcgcaaccagcaggtagccccattttgcgtcatctgttaaaatacgtttctttcccatagcttcctccatttttagacagtttccgtaaacagtgccgggcatcatgccctttccgttacggtgcctttgcctcgtctaccagcttctgcatggctgcaagcccctcatccaggctcacctcgccgctgtatatcttaagcagggcatcattaatctgcgtcttccagttgggtcttgatgcattgttcacactctgtaccccgtaagggaacatatccacgcatttctgtacatccagcttataatcaaactggtcgaaggcctgcacccaggtgtgctccagtccctcataggccgggatggctgcgcctgacagcccctgcaccctctgtccttcctcagaaccggtgaatttcaggaaatccttcgcgtattccagtttcttcccctttgccccggtggcataacacaggccgttggaaatggttgccctgccgtccccgtttaagggatccgggcatttgggcagcaccgctacatcccactttccttccaggttcttattgttctccatcatggacatcaggttccagttgccttccaggtacatggcgccctgctcggatatgaaggcggttccgggattggtttctgcaaaatatttctggtccgggcaccatggctccttttgcaaattaatgtaaaattccatgccttttcttgtggccgggtccgtgaaacctgcttttgtcttatcctggttcaggatatggccgcctgcctggtacacaaaattccagtaccccagctgctcatccgcatatgccatgaagccgtattttcctgtcctttcatgaattgctgcggacgccgctgtcaggtcatcccatgtccaggatccatccggatatgtaagtcctgcattatcaaacatttccctgttatatacaaggcagaccgtatccttatccttcggcaccccgtagatgcgtccgtccgacccctttgcattgttcagggagatttccgaaaaatgttttgtgtagtaatccgggtcctcctcatcataaaggtctgtcacgtccgccagttttccataatccgcatatttaaggatctggttagtatgcatccagaatatatccggcagctggttggattcagccgccgcatccagcttggtccagtactcatcccagctggtcacctggacgtcaatcaccacatccggattctgttccatgtaggccctggccacggactccatgccgttcctctgggccgtatcccatatctggaaggaaagcttcactttcccgtcccctgtttttcctgctcctgcacaccctgtgaccatggccgcggcgagcagtaaggctgttccgaataccagacaccattttaacgttttgtgcatagtcttccccctcttatacctgcatttttcggtttaaataaaccattttgttgcctttattttcttctttctttctgttaaccttatgatatcacgttgttttatccgggtaaatgttctgttaataccagttatatacctaaatgctatttttgtatctgtaggttgatattgggtagcatttgggtatataatgggatatatgcagtatagagcaaagtacacctttgcacaagggtgaaccagtctggcaatgatatcaaaggaggcgctacatgagcaatgtccttttttccattttccccaatgaacgttttgtggacctgggcttataccaatatggctgggagcagtgtgaacccctgcattcctatggcccttatgcacgcaaccactatctgttccactatgtgatatcaggcgccggaaccctgatgtccacggattccaaaggcatgaccaatacctatcatatcaaaagcggggaggggttccttatccatccaaagcaggttaacacctacagcgcggacagggaccatccctgggaatacacatggctggagtttgacgggctaagggttaaggaagccctggaactggccgggcttaccatggacaatccggtctatcactccaatgcaagggatctgagcctggaactgaagaacgagatgctctatatcgccaaccattccgaccagtcgcccttccacttaatcggacacctgtatctgttcctggactatctcacccgctcctcctcgtccaggaggatgatgcgcggcgggaagcttcaggatttttatatccgtgaagccacatcctttatagagcagaatttccagaacgacatatccgtggaggacatcgccgccttctgcaatctgaacagaagctatttcgggaagatattccgtgacgcggtgggcaaaagcccccaggaattcttaatcagctaccgcatgaccaaggccgcggagctgctgaagctgacagagctgaccataaaggacataggcaatgccgtgggataccccagccagctccatttttccagggcgtttaagaaaacatatggcatatcccctagggaatggcgttcggaaaataagattgcttccgggacggggaagatggggtgatttagacatgaaaatacctcctaagtagattttggttatttaccttgtctacttaagaggtatcatatcattacaagcagcggtccttttatgcaatcccacttttttccacggaatgatcctctattccatataatcctatatgcattcaatcttccctaatgaaatcagttccctggtacccttatggaagatgcataccttggtgcctgaaatatttaccttaacctcttccccttccgaaaaattaatgcttccaaacaccacggaccgcaggtttgtccccatacattctacgattaccgtggtttccattccgtaagggaaggaggatatgacctttgccgggatatttccctcttctccaattaatacatcttccggccgtatacccacaatgacatccggccccttggatctcagcccagcttcatcctccgcctctgccagaaaacggattcccgccctctgtaactccggatgaccggaagctgcattcatttgaaaatccacaaaattcatggctggattaccgacaaagtcagctacaaacatattcaccggctccgcgtacagcttcagcggtggtgcatactgctggagtacggccgtattcatcaggcagatggaggtagataatgccattgcctctaactggtcatgggttacatacacaaaagtcgcattggatgtgctgtgcagacgtttcagctccgtcctcatttccagcctcagtttcgcatccaggttagacagaggctcatccatcagaagaatctgggggctggccgccagcgtccttgcaatggccaccctctgctgctggccgcctgacagttctgagggataccgttccaggaaaggcgtaagctgcaaaagcacgcacagttcctctaccttttccttaatctcctttttcccccacttcaggttttccaacccaaatgcaatattcttatatacggtcatatggggccaaagggcataattctggaacaggaaacctacgctcctctcatttggcggcacatcgattcctttttcagcggaaaacaccagccggtccccaatccatatctcgccttcagtgggtgtctccagtcctgcaatcatccgcagcgtagtggttttaccgcaaccggaaggccccagcagggaaataaagctgttcgccggtatctccaggttcaggtggtccactgccaccgactttccataacgttttgttatatttcttaagacaatactgttatctgccatttcatcaaccccctataccagaatcaatggatgctccggtcaatttattcacaagtgcgttcaatgatattactataatcacaatcaaaagcgtaattgcattggcaaactgttcatagcccttttgattgtacatgaacagcagcgtcgtaagcagaacggagcccggcgtatataaaagtacgaacagctccatttcccttgtacagctgataaacggcaggagatatcctgacatgatgctggtcttctggattggaataaggatacggcacatccttttataccagggaatacccattatcattgccgattcctccagtgttgcgctaatctggaacatggagttcaggccggacctggacgccatgggcaggtatttcacaacgcctatgagtaccagaagggcgtaggagccatacagcgccggaatgattcctctcctggcggaaaacatggacaggtaaatggcggaaagggcaatactgggaatcagatacggcaggaaggtcaggctgttcacggtagaggacagtttcgtcccccatttcctggcaatcccatatcctgccaggcatcccacggtgcctgctccaagggaacagcacagggcaagaagaagggtattctttaatgccttccaaaaggtaggattcctgaatatgccggaaaatccgattcccgcatcctctgcaatccagtaacgcagtgtgaagttagacaatgaataatcaccctttacctgggtaagggattctgtcgcaaagctcacgaaggggagcagagtcaccgccacaacaaaaaccacgaccacggcactgattatcctgcggcctccccgcagtctggtaagtgatacgttggaacttttgcccgaaaccgttgtgtaggatttcctggttcccagcatcttctggttcagatacaatatggaaaaacttaacaccagcatcacaaccgcatatacataaccgcgcccgggattggtgccgttgagatagctgtacatctttgtggccaacgtataaaaattaaccggcaggcccagaaactgggccgtggagaatacactgagcccggatgcgaataccaggagtatggtggacagtacggccggcttcacaagaggcagtgttactcttgtaaatatacgcaaccgggaggttttaagaatctgtgctgcttcctccaggttagaatccatgttcttaagaatcccgccaatcagaatgtatgcataaggagcatagtgaaggcccgtaacaagcacaataggaaaaaatccataagcaaaccagttgggggtggccaatcctgtcaccgactcaaaaattccagtggtcccgccaatcaggctgttcttaaaaaagtttgtccatgcaattgccagtgtccatcccggcatgatatacaggaacatgaacaacgtggaacagatttttttacaatacatgtcggtccttataatcagccatgcgaacattccgcccgccacgattgcgataatgcaggaaaacacagcacacataagtgaattcatgagagggatgacaaaggtctgatatacctctcctgatgcaaatgtcttagtccagtgatacaatgtataggaacctgatgcttcgtggaccctgttaacttccgaagtatggacaatcaatgtatccttgaatatatagattaatggaacaataaccagatatatcagacagataagcaaaaccaaaagaatgatgttatggggtctgcgcaggaaatttccggcttttctagcttttactttcaatcaactcacctctattgtaaaatagaatggatacaaagatatcatatccatcctattttaagattaacgcagcaacccaggctgcatccggttaacgtaatgtctcaataaaatcttccacatccgcacggtgattgaccaggtaatccgggtcatccagtacgatattccccttcacttcgtcaaaactgtaatccgtggcatggacgttggcaggattggcggaaaaaccaccataataatcattgaacgcagcccagccattttcgctcagcagccactcagagaaaagtttggcagtattgggatgctggcaattatcaaggatgatggagtaaacaggatatgcatagcctcctaccggattgcatgaggataaatcataactcagcttgattcccttatcatcctgtgtactgaatctctgtgtgctgaaatatccgacccacgtatcagactgccccagggcgcctacggtggttgccgatgtggtatcagaggtggtcagcaggacaccattttggaacatcatcttaatgaattcccatcctgcattatccgttgtcagggttatatcctttccaaaatactccttatatgcatccgccagccttgacgcgtatccgtcggatgtaagcatggtcagcatatcaaagttaacaccctcgctggaaggatccttcatggtgaacagtcccttatactgcgggtcagcaatgcgccacaggttcgtgagccatccctccccaaccaattcatcattatacataaagctctttgtatcataataccaaatcagggcagtacaatcatcattgcccactatctctcccacccggggattggaccatttcatggcatatccggtatccaccagttccgccattacacggtaggtatcctgggcgcatactaaatctgcacttaccgcaccggactggcattctgaggtaatcttttcaatcatctctgtttcgcccagctgtgtaaattccaccttaatcccaaattcttttgcaaaccggtcagccgcatcctgcaagtatgaattggcgccataaaaaacaaggcctccttcttcctttgcagcagcaaccaggtcatcataactcatcccgtcctcctggccggatgatgcagcagaagcccctgcggattccggttccgatgccgccccgccctcttttacctcttcctttgcagcttctgttcccatgttcccttcagttccagctgcagttgcggtactcccggaacccccacacccgcttaacgcaccagctgccattatccctgccagtacgattgccatcagattgtttcttctcatagtatattcctcctcatattccgattttacttcggaaaccaacattaccagtacacggcagcacagttcccctgccatggtacactatagtttcatgtctgataaaaactccagcatatccgtattcttctcctgtacggctgcctggaccttctcatccttcgccaatacatccaacaatgcttcagccacagccatctcgcacagatggctgtaattcctgtaaaagtcaaacctggaaaaatcccctttggattcaatcacataatcagccagttcagccagtgatgaattcttataggcggtaatggctatcaccttaagactcctctgctttgccagggccacgccgtcaatgacgcttttggttgatccggactgggataccgcaagcaccaggtcactgccgccggccaggttaatctggttcatataataatcggccacaccgctgaaggtgcacttaatccccagtcttccaagcctgaatccaatatgttcaataatcggagtggtattgccggaagcaatcaggtggacctgatcgcagttccttaacagatccacgcaccggtaaactgtttccgaattaatattatccgcgatattcagcatgattttggagtattcccggaacacatcccccacactgttcaccgtattaaccatctcatgattctgataccttaccagttccttggaaagggacattcgaaacggccaatatcctttaaaacctacatgctggcacatcctcaccacggtggcctcgctcacatcacttgccagtgccaggtcctttacagtaaaatcaactacttttgcagtattcttcagtacatagtccgccagtttccgttctgtgggggaaagggtttcatactgggcctgtatgttttctattgcagatagttccgtcataaacagcctcctttttcacaatcatatatcctctcctgccattatactagaacctgcacaaggttctcaacctgttttcaacataaggcaaaagtctggaatggatatattccggcatatggatgatttttacaggatccatattccctttattatcggagatatactgttccatggcctggtaatactttccaagaaattccgtacccaggttaaacttgctgattccctttgagaacgctgtcacaagttggtcatccggtataccgcttcctccgtgtaataccaaaggaacctttgtaaccgcccgtatttcctccagtctctttatgtcaagatgtggggtatcacggtattccccatgggcatttccaatggaaaccgccagggaatccactcctgtctccctgcagaactgttctgcggcgtccggctttgtgtacaggtcttccttggaatcatcagcatcagaagccgcccccacatgcccaatttccccttccacaattgcgcccaggtcatgggctgccttcaccacgtcccctgttatctcaatattcctttccagcggatataccgatgcatccatcatcacggattcaaacccgcagcggattgcattcagaaccgccgctttggtgtaatcatggtccagatgcagtcctataggcacggcaacctcttcggccagttcctttaccatcccggcaaatccccttatacccgtggttttctggaccgggacatgctccggatacagcatgatgatggccggtgtattggatgactgggccgcataaacaaccgccctggccatattatagtcctgacagataaatgcaatggccgccgtgttactctccctggccatctgcaggatattacttaccttctcatacattcctttcccctctcccttctgatggtgttgcccctgaaccggctgcagtacctgtatccatatgcctgcatgccagaacaggcagcagccctcctgcaaaaaagtcccccagccctacagtagtcggcctgtccacaaaatccagatccttacacgcaacgcagcagaccagtggatctgactccgttacctgccggcagaatgcctcgcccttcgcgttcgtcttccatgtgcggatacgaccgtactcttccagcccaaaatcatcaccatggacatatcttgctgatgcaagcatgatcccgctttccaaggctcctttaaactcccgggcacctgttccatatgcaagggcccatatatgggtatgtatgataagaaacggaacctgaaggcatcggtaaatgtatctgactgcatccataacctgaaccggatcaaggatccgtattctttgtcccacatagtcctgcagttcatcctcattcatgcttatgatgtctaataccggggccaattgcctgtgcaccatatggcggaactccttgttgatatagcacccgtcctccaaaatcacggcagcgctatccttgagtccatttaatatatcaaatacagtatccagcctgtccctgagtatatatccgtccaacacctcgctgaagcatgagaggagaaagacatccgcatccctcaccatttcccctgcatcttctgctatcaccatatccatgctgtccttatcccgggatatgagaatccggttatggcatggcacggtaaaatcaatgtcattggcctggatatgtacgccagatggatattgcaggatgatatggggatacaccctatcatactccagcccgtttcctgaataaaattttatgccgggcggaagcagattttcaatgtaccggttaaaacaacacatcccaagggtgctttcaaatcctatcttccgtattgcgatggctgccctggcagcggttcccccgatagttgtcctgtatgtaaattcctctgcaaaagcattgcatgtccggaagtcatccggtatgatttcacagcctgtgccctgtctcatacaaataaggatttcaatcatcaggtccttaatggatgctatctggctcctttctgtaagttcaccagcatgtataccgtgcttcctgattagatgttccatcacagaaagatcccactccaactcaaagtccacacacgcatgaaatcctaatgcaatcttcctctcccctgttccctcaatgtctttatccttggtcctgccaatattgctgcccatgtgcccgtccacattcatatccatatgttgtccacattcctgtccatacgcctatacgggtcagcggtacagggatgccttccctgctgaatggaacaactggattttctgtcctgcgacctgcctcaaagtttcaatacagggcggatagattgcattgggttccctcaaggaccggtcagacagtacttccctgcatttttcataaaaaggagctttaatgtcacttgatatattgaccttattgattccatggcacacagcagtctcaatctcactgtccgggttggatgaaccgccgtgaagtaccagaggtaccttcgcagctttcttgatttcatccagtatgtcaatcctgagttttggttcaaatccttttggatacagcccatggctggttccgatagcaacagccagtgcgtcaatgccggtttcttctatgaaccgttctgcatccttgggatttgtataatgaatctcattcgttcctgtttcaatggagtcggtattgccgattgtacctaattccccttcgactgatacgtaatcagctgccgcatgtgccgtcccgcagacctttttacagagtgcgatattttcctcaaaaggcagcagtgacgcatcaatcatgacagaagtaaagcccaggctgatagccttcacgcaatcctcataggaaccgccgtggtccagatggatgcacacgggtactggtgcatgatttgcctcatcaatcactgctttaataaaggaattctgtacaaatgataattcatctgggtggatggccacaataaccggagaatcctgggcaattgattcctgcatcaccccggtgagaatcatattgctggatgtgttaaaggccggtactgcaaagtttttttctttcgcaactgccaaaatgtctttcatgtttacaagcatctcttctgccctcctgattgtccctcactgtaaatggtaacttgttttcatagctttattatattgctatgaaataaaatgtcaatatgtttttgtaatgaaatttcttttcagtcaatatagtgaaattaaactgtcaaatttgtgcacaactacgaagctcagccccccttcgtaaaatatgcctaataaaaatcaaatcctaaaacaatgttggttacgcggcagcagatggagggaataaattttcaaacgttccctggttttggacacagcaaaaagacagattggaatctgtctccttctgtatcatgattaaggtttaaggaaaacggcgaatcgccagatatttaagaatcattctcttgactaaggatacccatcacaattccctccagctcctccacccccgcagccatataatcaggttctatcccaccacacgccccaggatgcctgtccggatcatcttcacagccaggaaccccatgatgcctgcggttaaaccagaccgctttccatccggccctcttagccccaatgacatcattggcaaaggaatccccaatataatatgtatgccccacatccaggcccagcgcttcctgtaccttccgaaacacgcggatatccggtttcgcaacccccatctcagccgagatgaacacatggtcctcctctatccactgttccaatcccaacacgcggattttatcccgctggtgtccggaagggccattggttataagccccagaagggcgccctttgcacgggcctctgaaaggattcctgccatgcctgggagaagcccgattctttgctgaaacatcccgtatgcctcttggagccggagcgcatcccggggcttaagacagatgtccaggtcggcaaatgcatggaccagccggtaaacatacatatcctccattgacatccggccggattcggactggttgaaaacaagctcgctgtaatgcctgctgcgtacaaacaggcgttcatgatccgtcctgaaatcatttcccaggacctgcccacaggccagccggaagggttccagctggtcatacaaagtgtcgtccacatcaaacagtaaggctgtcatataccgtatcactccttcagccgtccaagctcctttgccgcctcctcaggcagcacgtcaatcaggctgttccgcttcagctggggcttgtccagatattcttcccgcagcatcaccttcacccgctccaggtcttcccataattcccttgcggaaaccaggcggcacccctggccgcggatgatgacctgttccagcccgtcggaggtggccacggaaacatcatgacggcgggcattttcatgtgcaaatttctcaatatactggtcggcggtttccgcctcttttgtgtataccacatggatgttatggtaatccaggatttcagtcgcatgtcccttcacccggtacgcgtcaaataccacaatcaggttgcactttttcacggcctggtaattgcacagcagatccataagacgtcccctggcgccctccatattgtcctttgccaggacattcagttcctcccacgcatagatgatattgtaaccgtccaccaggagatattcttcctggggcgcctgtttcgccgccggacggtaggtgcgtgtctccgggggattaaagctcctgcggctgccgccctttcccggtatcccgcttttctggcgcgccttgtcccggctgttggcataaaaggtcctgtttaatatggcgtcgatttcttctgtacccagccatatctcctcctgggcggaaccctccggcatggtcttggcaggtccgttcccggcgcttacatcccacaggccacgattcccgggcgccccgtccccccatgccccgtccggctgatccatcccctccggcagttcctttaaaatgccgctgtccacatgcatatactccttcacatggtcccagccaaccacaaagcccgcgccgtgggcgcagaacacggaaccggcaggatgatccgtatcccgttccggatcatatccaatgcgttccacgacctcttccgtattatggcagggttcgtatcctttcatggtgcatgtaagctttccgcatccttttgtgtaggaggttacttcggtctggtaatctcccatggacgccacgggagcgcttcccgtgagcacggccatcccggattccgtgtgggcaatggcacatgtgccggaccgcttttctatatccgtcatggcccgtccaatggatgtgtccggaatctccagccggaattcataccatggctctaacaggatgctgcctgcttccatcagtccctgcctgagcgcccggtaggttgcctggcggaaatccccgccctccgtgtgcttaatatgggcacggcccgccaccagcgtaatccgcatgtctgtaatgggcgaaccggtcaggacacctttatggactttttcctccaggtgggtgagtaccagacgctgccagttccggtccagcacatcctcgctgcaccgggcggcaaactgaagcccgctcccccgttcccccggttccagcaacagatggacctccgcataatgacgcaggggctcaaaatgtcccacgccctccacaggcccggcgatagtctctttatagactatattgcctgtcccgaattccacctcgaccccaaaccgctccgcaatcacgctctttaatatctcaatctgaacctcacccatgagctggagctgtatctcacccaggtgtccgtcccacaccacatgcagctgcgggtcctcctcctccagttccttaagctttggcagcatcacagcccggtcgcagccaggcggaagctttacctcataggtaaggaccggttccagcacaggctccatggaagctgcctctgccccaagcccctggcccggaagggtccgcgtcaggccggtcaccgcacagatgctgcccggcccggcctcagggacagcctcatacttttccccggaatagatacggatctgattcaccttttcttcccagcaggtcccttccgtcccaggacccgtcagcacggacttcaccctcaggcatcctccggttatcttcatatgggtcaggcggttgccctggtcatccctggatatcttgaataccctggccccgaacgcttccggatattccgggaccgttccataccggatgattccttccagcagttcctccacgccctcaagctttagggcagaaccgaaatagcagggaaacagcctgcgctcatataccaggcgccggattgtctcctcccccacctcccctgtctccaggaaatgttccagcgcctcctcatcgcacatggccgcctgctccatgaaatcctgtgttccagtccgggaaaaatccacgcaggaatcatccagcctggtcctgatttcacttaacagcgcgtcacggtccgttccggccaggtccatcttattcataaacaggaatgtgggaatcctgtactttgcaagcaggcgccacaaggtcacggtgtggccctgcaccccgtcgctgccgctgatgaccagcacggcataatccagtacttgaagggtccgttccatctcagccgaaaaatccacatgtcctggcgtgtccaacaatgtaacgtctattccttcccacgtcaatcctgcctgcttggagaatatggtaatccccctggcccgctccagggcataggtgtccagaaatgcatcccggttgtccacccttccaagcctgcggatgcttcctgcaagatataaaagcgcctcggacagcgtggtcttcccggcatccacgtgggccaacataccagcacatatatgttttttcactctttttggttcttgtccgcccatgaaaatatctcctcccgtgacagcatactttataaagtatatcacaagaggaggggttcgtcgagacactcttatccgccttcctcatcctcctttttcaggaaataccggtttttattccaggaatcaacgatttaccagggaaaaatcttccgtatattccccggtcccaaaatcataaatcaaaatctgatacggcctgtccaaagaaatccaaatggcaaaatcctggggttcaaaatcgccgtccgtgaccagttggccattaaaccgccagtatgttgcattttcaccaatcacagtgtcaacataataccatatgccctcaattccatttacatattcaatcccgctgatatagcttaaagcgtttttctccctatctaattcaggtaaacagttgtatatctcattttctaattctgccatcttttcgtagtgtccatgttcccagctgtatagttccaatctgtcataatccggacacgcaagatacgcctttttcccttccatatcggggattgaaagggtgaaatctgttttatcctgctggaacggtaatgtttctgctccataaaccagtacattgactacatccgcttcatcttcactttcctgccatacgacacggctgacacggcaggatgaccggtcaatcatgccgcgtatggtaaggtatcctgtttcctcatcatatgaaatgtccgtggcattcacttcatgcgtcggtaagcattcaccaatgacaaaaaccttcaaaaaaatggataccagaagaagtgttaacaaaccagcaaaaataccgatcattctttttaatttttttgtatgctgctgcaccttcttaaagccgtcaagcgcaagtgtttctttttgttcttcttctgggcccaatccctctttcatttccaaataaacccgattacactcctcacattcctccagatgccctttcaccacgtctgttcctgcttcgcttaatatcccatcaatatatcccggaagcagatcctggataatatcacaagaatgatctttattcatactttttcaactcctctctgattttttgttttgcacgataaaaaaccgttctgccccaattctcactcctacctaaaatttcccctatttcacggaaagaaagttcacctgtaatccggtaaagtactacctcccgttccagttctggcaggagatggattgcacggtaaagttccattttacgttcctgtttcagtatactggtttcgccatctggcgctgaatcatcgattaagtaatctgctaatcctactgtttccatctgctttcttttacggagttcctgatacagtatatgctttgctatctgacatagccatacagataacttgcaggtgccgtcataccgcgaaatagaatatactgcccgcaaaaatgtttcctgcatcagttcctgggaccattctgcatcgtgcgtatgggaatacagaaaccgataaaccaatttctcataatccctatagacagaatccatgtccatgctttcgccggatttccccattgtcccacctcctatccggaaaatcatcacttattgaaaccgctttatgaatgaatcattatttatatcacttatatcacaaaacaggggcattcgttacaagaatttgaaaatgatgggggtagggcgggcgcatcccccaaagaacagacctaattcttaattttcaatgaatatcttggacatttcccccattttacagtacaataataataactcgtaagaaggaggtaaatgccatgaaaaaaaggacatttttactggtctttctgacaaccatcctgtccttgggcatcttcataccggcttatggcgaagaaacccttattacttctgttcccttatccttttcctgggataagataccgaaagccggagatttggtaggagaggtatatgtcaataccaacagcaagcaattcacggtggagggggcttcctattataaaagagatgatacgtgggtttttggtgaacgtccggttgtggaagtagagttatccgcaaagagtgattaccgctttaccagcaacagcaggaagtatttctcccttttcggctgcggggcacagtttaaaaaggcttccatagatcctgacggcaactcccttatccttcaggttacatttcctaccctggacagcatgcttcccgcttccacttccgtcagctggagcaacagcaacgctgtatgggatgaggtggagggttctaagagctatgaagtccagctttaccggaacaaccgcctgatgaccaccgtcaaggcccagcatgaccgctttgattttcgttcctatatcaatctggaaggtgattatacattctgcgtcagggcatacggcacctacaagtcgcaggccagcccctggtctgagagatctgaatcatacaccgtcaccaagaaagatgcctggtattttgataacgggacatggaagagggaccggcttggacgccgctatgtctataagaacaatgcatatcccaccaatacatggcggtgcatcaataataagtggtattactttaactatgacggctatgtacagaccaactgctatattaagtcaacggaacttgatttctattactggcttggccctaccggggcctgggacacggaaaaagataccttccacccggatattgcaaagtatgaaatcattaaagagtgacgcctaaggtaagtaaagcatccgaggcatattaagaaaagcagccaggaacatccttacagaaggatttccctggctgcttttgtgttaagatggattgaacggataacccgaaaaatggatttatgaacacccatgttacatatcatgtcactgtgccggtatgtttcccgcctgccgcatcctggcttccaggaatccctccatcccatccccgggcagcggctttgaatagtaatacccctggatctgttccacgcccaggtcaatgaccatctgcttctgctcttctgtctccacgccctctgccaccacggacatgcccaggtcattaaaggcatggaccagatgtcttatggtcaattcggatttcctgttgtccatggatgcctggacaaaactcttgtccagcttaaccgtgccaaagggaatctggattaccgttgcaatattggaataaccggtgccgaaatcatccagacccatccggattccatgtttcttcatctctatggcaaaatccgtcaccacctggggattctccgccagggtactttccgtaaattcaatcttcacagcccccatgggcgtcccattccgctttatgatgtccagcaccttcctggccagatccggctgtgagaactggatggctgaaaagttgacatggatggcttctatgggaatcccctttcccagcagatggttgatatatctgcacacagtatccagtatcacatatgtaaggtcgataataagcccggtctcctctgcaatgggaatgaattcagacgggtacacagggccaataggcgtatggttcatacgcatcagggactcggcaaaccggaagtccccggtatccacagagtagatgggctgatagtacagctctacctttttttctgacagctgattttttaatacctggatgatctgcttcctgcgctccagcttgccaagcatctcctggtcacagtagagcacctgcccgtaccgccccgtctttgcctggtacaccgcatattcaatggcgctgaccgctgattccagtgtattcacatattcggaacggcggatgatccctatgaccgcaggaaggatgaattgataatccctgttctgccagggctgcgccatgcgcgtctgtatatcccccacacatttcctcacatgccgctcaagcctgtcctcctcatcggtaaacagcaatgcgaactcatcgccgctgaagcggtatacattgccctgggggccaatcccgcacagaaagccgcacacttccttcaggaattcatccccgccgtgctgtccgcatacattgttgacctggcggaaatcccggatggagacaaccatgagcacaaagtctttctcaggatgctttttcagcattaggtccagcatattgagaagttcctggcggttgggcacattggtcagataatccagggaaatctgacggttctgtaaatggagatagatgataagcagggcgcaggttgcggctgagcctgaaaggatgatttcgggatagagctgctggaacaggattaccagcacggccaggaccgggaaggcggccaggatacggtaaatctgacggtcaatgtaaatcctgttcctgacagccaccaggatacagcccacacagtaagcataaaaaacaagataggtaaggaggatgcagtttccctgggtatagtttccttctgtaatgctgaacatacaccctgtaaagggattggacagaaccagcagggcatagaacaccgccggtatgaccccggccaggatcatgttttttaactgcggcctctcctcatagataatggagacaacataaagataatacaccagccccatcaaaggggtcaggataaaataaaccgtggtaacagcccaggtgagcaggaccggcacccggatataatcatagagcatgaaggtagaaaggatgttgcttgtcatggctgcaaaggtcacggtgagacagccctggaacatcctgttcttgaggcttggaagatgactccctttccgcgaatatacccatatgattcccaggataactaatgatattgtctcaggagctatgttccacctcactgtccccacctgccgtttcccacttttgtgttccttttatgttctatcatatacccaaattacatttacagcaatatccaatttaaaaagaatatcttgtaatatatttccgtttgcaatattttttagatattctaaaaatttttgttgataaattctactatatttgttacaattcatggagaagcaatctacaatatctacaaaaatcaggagggtattatgaaacaaatgttatttttagtcccgttgataggtcttgcaggcctgttgtttgctgtctttctaaggctctatgtaatcaggcaggacccgggcaatgacaaaatgagggagattgcagatgcaatcgcagaaggcgcaagagccttcctcacatccgagtaccgcatacttgttgtctttgttgccatcttatttgttgtaatcgggcttgggacccgcagctgggtaaccgccggatgtttcctggttggaagtattttctccaccatagcaggctatctgggaatgagcgctgctatccgcgccaactgccgtaccgccaacgcggcccgtacctccggtatgcgccaggccctgtcccttgcattttccggcggcagcgtcatgggtatggcggttgtggggcttggccttatgggcgtgggcgcgctttacatcatcacaaaggatgtatccgtcctgtccggcttcagcctgggcgcatcatccatcgccctgtttgcccgtgtgggcggaggtatctataccaaggccgctgatgtgggcgccgacctggtaggtaaggtagaggcaggcatccccgaggacgatccccgcaacccggccgtcattgccgataacgtgggggataacgtaggggatgtggccggaatgggcgctgacctgtttgagtcttatgtaggttccctgatttccgccctgacccttgggcttgtattctatcaggaatccggcatcctgttcccgctgctgctttccgcatccggcatcgtggcctccatcatcggcgccctgctggttaaggccatcggcaactccgacccgcacaaggcgttaaaaaccggggaatacagcgcaaccgcactggtggtcatctgcgcactggccctcagccgcacctttttcggcaattaccttgcggccctgaccatcatcacaggactgttcgtaggtgtattaatcgggtttgtcacggaaatctacacctccggtgattaccgttttgtaaagaaggtggccgcgcagtccgaaaccggttcagccaccaccatcatcagcggccttgcagtgggcatgcagtcaacggctgtccccatccttctggtgtgcatcggcatccttatatccaaccgccttatgggactttacggaattgccttggcagctgtggggatgctttccaccaccggaatcacggttgccattgacgcctacggacccattgcggacaatgcaggcggaatcgcggagatggccggactggacagatccgtgcgtgaaatcaccgataagctggattccgtgggcaacaccaccgctgccatcggtaaggggtttgccatcggttctgcggcgctgaccgccctggccctgtttgtgtcctatgcagaggcagtgaagcttaccaccatagatatcctcaacgcccatgtcatcatcggcctgtttatcggaggcatgctcaccttcctcttctccgccatgaccatggagtccgtatccaaggcagcccatcagatgattgaggaagtacgccgccagttcagggaggactccggaatcctgaaagggacttccagaccggattacgcttcctgcgtatccatttccaccaacgcggccttaaaggaaatgttcctgcccggactcatggcagtgctggcgcctctggccaccggactgatccttggcccggatgcccttggaggcctgcttaccggcgcacttataaccggcgtcctgatggctatcttcatgtccaactcaggcggcgcctgggataacgcaaagaaatacatcgaggaaggcaaccatggcggaaaaggaagcactgcccacaaggcagccgtggtgggtgatacggtaggcgatccctttaaggatacctcaggcccttccatcaacatactgattaagcttatgaccattgtctcccttgtatttgccccgatgttcctgcagtatgggggattgctctaaatcctcctgaacggccttaaaaacagacggacgaaagacacgtccctcagggaaaataagattcagccggaaagataaaacggcaaaacgggttccaggccaataccggccggaacccgttttctgtcatcccttctcttttttattgtttggaaagcccggctccattggttcggatgatttccttgaaccagtaaaaggattccttggcatagcgttcccctgtcccgcttccgtcgtcatcctggtccacgtagatgaaaccatagcgcttcttcatctcccccgtggtggcggaaaccaggtcaacaggcccccacatcagataaccgaagcattccacatcatcttcctccaccgccagccgcagctgctccagatgaagcttcagatactcaatccggtagctgtcatccacggtcttgtcttcctttaagatatccactgcgcctaacccgttctcggtgacaatcagcggctttccgtatttcctgtatactgcattcaggagatagcgcagtcctttggggtcaatggcccagccccacctgctctgctccaggtatgggttctgtacgccgccaaacagggtttcctcaccgctttccccatcgtggtggcccacgcttgaggagtagtagtttacaccgatgaaatcaatggttccattcttaaagctttccgcgtcctcctcaacgccttccggcacaatgcccatcttctcatattccttcagcttgtagcgcggaaagcatcccatgcacatggcgtccacctgatagaagtccctatacatctcccggaaggcctggaacgcattctcaggcttacaattgtaggcatagacgggctgaagcccgaatacgcatcctatctggttttccgggtctatacggtgcccaagttccactgccctcacgcctgccgccgtcatattataccctactgccgccagtgtcctggcaggatcctccatctctgaaaacttcagccccgctatcatataggtaaagatatctgatgcttcggtcgccgggtcaatgtggttcatctcattgaatgtgacccagtaccttacctttcccttcagcgcccggaacatggtctcacagtatctcagataaaaaccgatcagcttcctgttggtccaggaaccgtactccgtcaccagatgatacggcatttcaaaatgatacagcgtcacaatgggttcaatcccattggcaagcagttcgtccaccacatccgcgtaatagcggataccttcctgattcggctcttcctcatcccccatgggatagatcctggaccagtccacagagatgcgcagggccttaaatcccatctgcgaaaataatccgatatcctccctgtagcggtgataaaaatcaattcccctgtgggatggataatatttcccgtcctcaatttccttacagatttcccttgggacttcgtgggagccgctggtcaccagatccatgattgcaactccctttccgccctcctgccatgctccctcgcactgatgggccgcaatgctgcctccccataaaaagtcatctctcatccttatctgctcctttaaacactctaaaatacaacactcaggcaatcttcatccagacggatgttctcacatacagcgggaatcacatccaggaaatgggttgtattggtgacaatgaccatgatggtcgtgtcatagccctccccttcaatggctttcatatccgcttccaccagaagctgtccgcgctccacccgctgtccctgctctatatgggccgtaaaatgttttccgtccagctgcaccgtatcgataccgatatggattaaaagctccacgccggaatcacttttgattccaatggcatgtttggttgggaacaggcataccacctctccgcttacaggcgcatagacctggttgcccgaaggttttatggctatcccctttcccatggccccgctggaaaatgccttatcttccacctgtgacagctgaaccacctcaccttcagccactgccatcagtggttccctgtggatattcccgccgtccgcgtttcctgcctcaggaacgtcctcagctgattcagccggggcctggctggccggctgttttttgcgggcttttccgaaccggaacaaggaggttccttctttctgcgcctccccttccggctggcacaggataaaaccagcaatggctgcagccacaaatccaatggcaaccgctgctatcatataatagaaattattgaaatcattgacaccgatataggaaggaaggcctgccagcccccatgccatggtatatgtcttaacccccataagtcctgcaaacagtcctcccagccctccgccgaatatgacagccaggaacggacggcggtatttcacaaacacaccgaacacagccggttccgtacagcctaagatagccgagaagctgaccgtgccgaataattctttctgtttcgcatcctttgcacggaggaaatatccaaacatggcgcctcccactgcaatgtcggagatggtgcaggctgccaggaacagggggtcgtatcccatttccgccaggaaggccatgaccaccggcataatgaagtttccggctcccatcatgatcaagaatggctggattgccgcataaaaagccaccacgctccagttgcccagggtattggccaggaaggtacatacaaaactgattccctcgccgatccaggttccgatgggcccaaagaacatcagggtaacgggcagggttatcaccagggtaaataccggaatcaggaaatactgcagaaggttaggtatgaccttcttaaggaatgcctgcacatatcccatgaaccacactgccagcaggattgggataaaggagctggagtaggttatggccggaaggggaatcccgaatacgctgagtccttccaccccgttaatggaagcagagagtagggttgccgccaatgccaccgcaaggtagggactggcgttcaggcgtttggcgcatgccatggccatgaatacggggaggaagaagaacacagcccccctgatggagtccaggacaatataggtggggctgtccgccgacaccagtcccatcagggataccagggacagaaggcctgccagcatacctgccgcgatgataggttccagcagcggtgtcatggattccgataccaggtcaagggccgccttaaatggattcttcctggtcctgacctggggtcctgatgcctctgtgctgattcccagcatggatatcagttcctcatgcacctctgaaacatgggttccgatgatgatctgatatgccacgtcgttggacaccacgtcaatcaccccgtccatggccttaatttcttctgtttttgccttgctccggtcctttaatgtaaaacggagcctggtcatgcagtgcacgaccgcgctgatattatccttgccgcctaccaggcggatgatgttttcattcattgtctgatatttcatcaatcttcctccttcttttcatttctgttcgtaaccctgtgtatatgcaggataagatatgtttcctcatcgatggtcagttccatcttaaaattttctttaatgtacgcccggatttttacagcgcacccatatgcggcaggatacagcatcctgacctgggaattcagcgccttgtcattatcctcaaatacctgtccggcctggagccgctgtatgaaatactgcagatgggtaataaggcgcatatagttcacagatgactcatccagacgtatattatagtgatactggatgatggacaggatatccttaaggacctgcatggcctctatcgtctccttcaggtccttcccctcggactgcaggttgacgaaatgaagtgcaatggataccgcctcatcctcaggaaattccacatggaaccgttcgtttaacagctccagcgcatgcaggccgatctggaaatgcctgggatagaatttcttaacctcccaggtcagggggctgcggataaactgccctttccccgcacgtttcagtgcaaagtcaatatgatccaataaggtcagatataaataatcatttgccttctgccccagcagcagctcgccctgtgcaatgacatcattgacaatgttcagatattcctcgtccgtgttggtgagcaggtagctgaagtgttccagcatatcattggagtctaaaacatatgttttctcgatttcattttctcctatggactggccagccttttttctgaatgatatgcctttggagtaaacaatcagttcactgcccccttttttcaccactgcaacattattatttaaaatctgacttatcttcacaataaatcctcctttccagaaaaaaaaactcaaactacacggaaaataaaaattttcagtgtaatctgagttctgcctgcgtaccagtaacatactcacttcgtgactccctagtcacataagttttcttttctaagtttttctctgatttttattctatataataattctcacaatgtcaagccctattttcaattaaatttatggaatatttacagtacctgaaaagctggcttaggcaagtccgcctgtcattcatcaaatatgctgacaatctcccccttcagtatccggttcatattcttaaccgcgcagaaattgccgcacatggagcaggtgtcctctttctccggctttgcggacgccctgtacctcctggccttttccgggtcaatggaaagctggaacatgcgctcccagtccaggtccctgcgtgcagcgctcatctcatgatcccactgtgcagcccctttgacgccctttgcaaggtccgctgcatgggccgcaatcctggatgccatgattccctccttcacatcctccagatccggcagccgcagatgttccgccggggtcacatagcataggaaggacgcgccgctggcagcagccaatgcccctccgatggctgcagttatatggtcatatcccggcgcgatatccgtgaccagcggacccaggacataaaagggcgcgcccttgcagatggtctgctgtatcttcatattggcctcaatctggtttaaaggcatgtgccccggtccttcgatgatgacctggacattcttatcccacgccctcctggtaagctcccccagcgtcaccagttcctctatctgtgaaatgtccgaggcgtcctcaatgcatccggggcggcaggcatcccccaggctcagtgtcacatcatactcctggcagatgtccagtatctcatcaaagtgttcataaaacgggttctcctgccctgtcatctccatccatgcaaatatgatggaaccgcctcttgatacaagattggtcaggcgtcctgcctgtttaaaacgctctgcggtccgcctgtttatacccacgtggatggtctggaaatccactccgtcctccgcatgcattttcacgatatcaatccattcgcgggaggtgatatcctttaagggcttgtgataatacaccacggcatcatagatgggcaccgtgcctatgatggccgggcattcccgggtcagcatcctcctaaaggtgcgggtatccccgaaggagcttaaatccatgatggattcaactcccatgcggactgcgtcattaacctttaaaagttccatatccaggtccttacagtccctggaggtgcccaggttaacattgatttttgtcttcagcatggagccgattccgtttggttcaaggcatccatggcgcctgttggcaggaatggccaccttcccttctgccaccagcctcatcagctctgccggttcaaactgttcctttgcagccaccttcccaagttcctttgtcaggatcccctttctggccgcatccatctgtgttgtgtagttcatgtctttcctcctcttctttttatggtaaataaaaatggcccactccgtcaaggaatggaccatgaatgaactcatgcgctgcatctgccgcgcaaatcagatgcgcggttgatgtacttccatattttccctacgttggcattatccaaatcaggtataataggtcgaagttcgattacttcctctcagcctgcttcacaagctccctgttgtggttgtatcatataaaaatcttattatatccgtatcatcagtttattcggtattgttttaaatgtcaagctttaaatttcagcctttaaatgtcagccttattctgctcccgcctggagggcagacggtgcttctccccccactcgcacatcatgtccaggatgggaatcagtgatttgccccgttccgtcaggctgtattccaccttaggcggtatctgtggatactcttcgcggtgcaccagctggtcgccctccagttccttcagcgtgacgctgagcgtcttgtatgagatttccccaatgtactttttcatctcattgaaccgcaccaccccaaattccataagggtgtagaggattgtcatcttatatttgccgtttataagggacagggtatagctgaatcctgtctccccaaggctggcctgtgatatggagcattttcccatcttacactctccttcaggtaagtaccatacttctatgttagtaccgcaccttgatgttcgtacttgtaatttataatgatactgttaaaattataatatgtctaaaaagaaaagtcaatcacggagcgtaatcatataatggataaaacatgcaataaaaaacagaccgggtcatgtaccggctcatgctgtgcacagacctgcagctatcaggtttcggggaatacggccctgtccatggattggggcggcaatgccccaagcatcatccgcagcacccctattgagttcagggaactgtccatcgcggaccgttcatggatggcccccatcctggcggccgaggacagcctggcatccgatggatgctttgggacgttctttctctggggaagggcgtatggaatgactgcggcagacctggggagccggatgattgccaggtaccaaacggaggatggactgttcttctcctatcctgccggcagcggaacactaaaacctgccatcacccagatgaagcggctggcggaacagctgggacagccccttttaatcaagggcgtgaccgaggcgcagaagcaatgcctcctgacggaattccccacacagttccggtttgagggacttcgggatagtgcggattatatctatgaggcaggaaccctggccagtcttggggggaaaaagctgcataataaacggaaccactgcaaccgctttgaacaggaatgtccggactggcattttgaagtgctgggacaggaacatatagactcctgccttgcccttctgcaaagctgggaagaaaatcatgaagggcttgaaagcggtatgccggaagcggaaaaggaggccatcctcacggcctttaaacattatgatgccctggggcttacaggcggcgtcctctatgccggggaccggctgctggcctttacctttggtgagccggtaggcggacatgggtttgatgtaaggttcgagaaagccgatatcacggtccacggcacataccagatgattaaccgtgaatttgtccgccatctgcttaaggtctatcctgaactgcactatattaaccgtgaggaagatatggggatggagaatctgaggaaggcaaaggaatcctactatcctgcatttatgctggataaatatgcggcccgctgggaataagcggaccgcttcctgtttcaattaatcctgtttcaattaatcctgtttcatgtaatccggcttcctttcatccggcttcatcccccctgttttttccctttcccatccgcctccagtatccctctcctgattgcctcaaatgcaatgggcgcatatccaatccgctccacacaggcacagaaactccgttcagacacatccgcatacatggggttgttgtggacatgaccgaatatattggcatagggactgtatatattcacatacatgggttgatgggatagtatatagaattcctctaagacaacgggaaggaaactcacctccccaaatcccatatccatccaccttcggctgtcaaaatccctgtcatggttccctgctatcaggatcttatgtccattcagccttcccagtatggccgttatctcccctgcgtccataccgcaggcaaaatcgcccagatgatagaccgtatcttccgccccaaccacacggttccagttttcaatcatctgctcattcatctcatggccatccttaaagggtcttccctcatatttcagtattgcgcctgcatcgccaaaatgggtgtctgatatcatataaatatttcccataaaatcctcctggttgccttttgcatattttgtatatttatattattttatttaatatcatgttcatttgatatgattcattttaccataccaccatggcaaatcacaggcccatctcgaatattggggacttaaaatattcaggactgttttttgaaggatcttacagtctccacacccccattcataaaccacatctgccggctgaacctgtcatccacggaatccatcagcatctgctcatggttcccacggatcaggacgcagcgttcccccatatcggatttcagcgtcctgacataatcaaatacctcataaacctgatttcccctgtcaatcagatccccaagacagatcagtctgtccgtatcttccctgaacttaagctttttaagcagcgccagcagttcgctgtggcatccgtggatatctgcaacgattatggtcctcatacatgcctccagtcttattcccctatgataattatatctgaaactgaccggaaagcacagatacttttgattttatacggcttttacctcattccatttataatatcaagatccgttaacatcacgcctgattttcccagtacttttgactggccttgcagaactggattgttaaattgaaatatgcaggcatatatctttgcctcccttcgtatttccgtaaaactattttatcatccatctttaaggcatacaacctgtattatacaaaggcgggatgttcagtcagagcatgtatgattggaagattcactatcaggaacacagaccttgcaggatattgtaatatccggcccctgcatccaaaaggatgggaatctgatactctttgcatccaaaaggcagcaaggatgtcatcccctgctgccctgcataaaaccatatcttatcttataaacggatcaagacatccccatctgtcatcttatctgcatcctccgcactccctacagccacagactgcagataaaggttgcacacaggccgcctagggacatcaccacattactgatggacaaggtcttaagccctgtcttcatatcaaatcccatacagttggtatatacccagaaataactgtcatttacatggcagcaggcccttgcgcctgcaccggatgccaggaaaataaggattggattaaggcccaggctggccgcaatgggggcacacaaggtagctgctgttgtcacggccacggtaccagaaccctggactatctttaacagaccagaaatcacgaaaggtataaggataaacggaagccctgtattcactaccatagtggcaaggctgtcacctgcgccggatacctttaacacctgtcccaatgcaccgcctgcggcagtaatgaatacaattgggcctgcatcctttaacgttttgtccatgatttccagcacctttttaccgcccaacctctttccaagggttgcgattgcaagaaccgcaccgattgccagggcaatattggaatccccaataaaagatgtgaccgtaagaagcagcgagccttccgggcacagcatgtcacatgttgtctttccaagaatcagaagaatcggcacaaccaatggaagaaggcttgccatggttcccggtaggtctgtttcatcctcaatatccagaccctcctcctccttttttccagattcctggaaagaataaaaatcagaaggcttgttgcggaaatatatctctgcaaaaatccacccaaacaaggtcatgaaaaccgctgcaaatgctccgtacaggattgcctgcccgatatcaatcccaagaagccctgccgctgccagagggcctggtgttggcgggacataaacatgggttgccagcaggcctgcggaaagactgactgccaggattgccagaggtatcctggtctttttgtggattgcctttacaagcggcgtcaggatgacaaaggctgcatctgaaaatacgggtatggatacgatataacccgtgattgccatggccagtccggcacgtttctgtcctaccagcctgaccgcgtccagcgccatacggttggttccctttgccgcatccagataattgcccagcatgattccgaaaataatgatgatgccgatactcttaacggttccggaaaatccgcctgtgatggccccgattgtatcagctcctgtcattccggacagcagtcccatgacaagcgcggttgcaagcagtgaaataaatgcattggcctttaccttaagacacaggaacaagagcacggccatacctattataaatacaatttccattggcataattgaatccccctattttatcgatttgtgttcatccttctttttcatccttcttaaaccttgcccgcatcaagggcttgattccccctgcctccaggatgttaagtgcatgttcccccagctgctcgcagacgtaaaccttacctgtttcttccactgtaaccacgccttttcttatatccagcttcaacgtctgcccgtcatggacctccttgcctatgcccttacatataatcaggggcagccctaagttgatggaattgcggaagaaaatccgtgcaaatgaatctgccagcacagcagacgcccccatgttaagcagggcaatgggcgcatgttccctgctggagccgcatccgaaattagtaccggcaaccacgatgcctcccttggggaatgaagaagcaatggattcatccaccccgcccaggcaatggctgccaatctccccagggtccgtaattgccaggaacctgcccggataaatctggtccgtgtcaatgttattgcccaaaacaatgattcttcctgttatctctgtattcatctatattgcctcctataagtaatcccgcggatccgtaatgcgaccattgatgatactggctgccaccgtggccgggcttgccagatatatggatgcctggttggatcccatccgccccgggaaattccggttggtactgctgatacaggtttcacccggcgcaatgattccctcatgggcgcccaggcatgcgccgcagccaggcgtggttatggttgcccctgcattcattaaatcctgtatgtatcctttttccatacaggaaagcatgacctcagaagatgccggaaccaccaccagcctgctgtatgggggtatgtgcctccccttcacgatcctggccgcaaccgcgatatcctcctcccgtcctcctgtgcagcttcctatgtatccctggttcagctttatctccccttctgcaatcacatgggacagtgtatccacattatcgacgctgtgcggacatgccagctgaggttccaaaccggatacatcgaacacatgacgttcgctgtactcaaaaccaggatccgtaacctgtacctcaaaaggacgtaccgcacgctttgacacataatcaaggacatcctggttcggctgcatatatgcggtctttgcgcccatctccacggccatgttacagatgaccatcctgcctgcaacattcaggctgtccacatagcttcctgtaaagtcaatggccttataaacagcgccgtccgccttaatcctgcccaggacattaaggatgacgtcctttggaaatactcccttgggcgcctggccttccagacgtacctcgattatctccggaacccggaaccacagttcccccgtcatcaggatcgtggccatatccgttgcgccgcatcccgtgcccatggcgccaaatgcgccgtgggtcgtggtatggctgtccgtggccacaatgatcatccccggataaataacccctgcctcaggcatgacctgatggcagaccccacagttggtatcaaaatgatacttcaactggttcttcctggcaaactccctcatctccccgtggttggccgcacttttgatgtccggcgctggtgcataatggtcaaagacaaatgctgcccgggtattgtcccagaccttctccccacccatttcgtaaaaggaataaacggtctgcagatataaatcattgatttcagcaaaatcaatctttgcagtgatgatctcaccggtctttacatgggtacggccgctgttctttgcaagaattttttcaattacatgcattattttctcctccttttcccttttttgaaatcgtatattgtatacgatattcaatctacgtgttaaacattagcataattaaataaataatgcaatatattttttagttttgtttatatttttgtgcatattttacaattcatactacactcagttatggcatttgacaataaaaatgggggtatggtatgatgataaagataaaacattcgaggtgaaattaatggaatctctggaaatgatgcctgcaagggtccggattacatctatattaaaaaaagcgctccttgcaggagaatataaaagcggccaggagctgagcctgaccgagatagctgaaaaacttggagtcagcaggactcctgtacgtgaagcatttcagacccttgctgcagagggcctgattgaactccgtatgaataaaggggcaattgtaaaacagattgaccagaaattcatcacggaccattatgagatgaggatcctgctggaatcagaagcagccgtaagggccgccagaaatggaatggatgtatcggaactgcttgccagactttatcacctgacggacaacctatccaccttggaccgaccatactacacggaactgaatcagcaaatacatacttccatctggacagccgcggataaccagaaactatataatttcctgatgagcctatggaacggccccagcaccggcagtgccaactcagaactggaccactatgtccagtccacagaggaacatatacagatacttcagtccatacgttccaaggacacggtaaaagcacgtcagatgatggaacagcatattaccaggagcatgaacaacatcctgaaaagctaccgcgccgcccagtaacccatgaacctaaagcagtgcattcagcttctcctcgtccagtccatacatctcccgtcccttaaccttaaagtatccgtccctctgcatcagcttcagttcctggttcagggatgagcggctcacatggagcatattggccaggatcagctgggaaccgggcataaggacgctttccacgggagacaggttatggagtcccacaatccagtaagcaatccgctcccggatggtctgatagttaaggcagttaaggtacagctggtccttcagcccccgctggcagacatagagaagcagcgcatacatcagtccctggtccttttccagcatttcctccagtacctggaccgggatccagagaactgttgattttttctcagcaatcaatgtgtatgcgtaattcttcctgccggtaaaataaaggaattccggaaataggtccttggcctcaaagtaagaatggcactgttccacaccattaatcgtattgttcacagccttcaggatgccgctctccacaatcccgaaacagctgatttttgttccctgggggtgtatgcactgggacgcttcataggtcctgcgcacaaaatacgtgcggtactcctcatttcttttgcagaggtctgcaaaggggaccctgcatgcattctctgagattgtaaaaaaatcgcgcatattccttcctccatgaactaccgaaagaggggctgtttcaaacagctcctcttctggtaatgtcttgttttcttcctatccctgcttatataaggttcaggcctactccaatgggcggtccaggatatcacacagatcgtcataatccatctcgccattaaacctcagtacttcctttccattccggaatatgactacgaccgggataccgcccacattgtaggtgtccaccagatcctggtttgcatccacatccacatagcggatttcgtatgccccgtcatattcttccttcagggcttcctccagcacagggtgaagggccttacaatggacgcagcgctctgcgccgaacagtaccagcaccggtttatcctccactgccagtacctcatccttccagctggccgcatcgacaggatggaatacatccgtatccacctcgaagaccttttccctttgtgacaggtcttcctcgtcatccgttgccacacagagggccacatcttgataatacggcaaagtcccctcaacgtcaatcaccttttttgccccgaacgcgcctgcgcccggaacacggtaggtcacattgtcaatccgctcaatgggaacctccactggttccggctcctgaggcacatagctgtagggataacggtaggccctgtaaatcatattgttcttcggacccttttcattgtgcgtataatatggtgaaatccactcccatacaatctcaaggtccggcgtcacctcgatgagcctgccgtccgagccttctgttaccagggtatttccattgggcagacgttgtgcgctgctgacataggggctgtagaatttgctggcatccgtgggaatcgcatgccccagttccttgggggtcagcttccataccacctccagtgtaacaggattgaattccagcacgcggctgtaatccctcagtgcatttttggtgccgattggagatgatgggttgggtgtcccgtagccgccccagccgccattgtcaaagaccatcaggtttccttcgcccggcaggcccttgggaatcatatggaaatgatgctgtccgataatccatcccagcttcttaagctccggggaagcgttaaaatcaggtccgatgcgccatacaatctttcctgtctccttatccaggattgccaggatattggcttcgcggcagtcaaagatgatgttgtcaggcttaaaacgcatatctccctggtcataccatttattaggcccaagatagctcatgcagttcacatgcaggtaatcgcccacgccgccgtccgatgcgcgcaggttggggtcgcggaacagcacgttcttagccgcctcgtcaaatcccagttcgtcaaaatgctcactgatggaccatttccaaaggatattcccctcccagtccacttcaatcatggcatcatccagcagtttcttatccgttatcttaggattgtggatggtctggtgcaccaggatcagggtgttgcccgaaagcggttttgcatccataccgggtacgtaataccccaccgggtttccctctctctggtaatcatggtgctggcgcgccatccatctgtggtccctgcccgggtcgtcaatattctcaaaatggtcaaattcccatacaatattgccgtcgtagtcaatttcaatcaggttgacgccgtcctgcatgccataatcaggatggcggtatccggaaaggcccatcacatatccgcccggaagaagctttggcggcatggcgtgcatgttccagcgcctgacctcgttgccgttcatatcaaacaacaacacgccgtcattgattaacggaacaatcgtataaccgctccagcatttttcagggttgtaaacagtgactccgtgtggaaaaacaagtggctgtcccatatttcatatcctccattgaattattattatttgttaaaaagcctgtttgatttcaaccagctttccgttatcgtaaaatgcccccgcaaccgtccgattaagcttcaggctgttgtagagcaggttctgtcttgtgatatcctgcctgtataccttccactgtccgcttaactcctgctccagactggcggtcttctcaatatcctcattgctgtacgggttgtagaataaaaatgcggtcctgcccgaatccgggccaaggattccctggatctgttccaattcctttacatagcgctccgatgcaaccgccgcaaccgcgccgtccgccgccgaggtgactacctggcgcaggaatgtctgggtgcaatcgcccgccgcatagagtcccggcacattggtctccattttctcattgaccttaatgtaaccggacctgtcacagtccaccatgtccttcaccagttccgtctgcggcaccatgcccacgaacaggaacagcccgtcggccctcacctctgtttccaggcccgtgtcaacgttctttaataccagtgattccacatggccgttccccttgatttcctgtaccgtggagctccacacaaaatctatcttggggttcttatacgcatgctccgcggcaacctcgttacagtccagatgcccttcctcatgaagcactacaatggtcaccttggatgcaaacccggtcaggtaatccgattcctcaatggcctggtcccccgctcccaggacatagatttcctttcctttgaaaaactccgcatcgcaggtcgcgcagtaagcgaccccatgcccggtaaattccttctcacccttgatatccagttccctgggcctggtgcccagatccaaaataacgctgcgcgccataaaattcccgcggcgctttgtctccacaatgaatgtaccgtcctccttccggacccctgtgacagtggtacgcttaagctctaccgtgggatggctggccgcatgctccctgaacagttccatcagatgctgcccgctgtccgctttcgttcccggataattcctgatttcatacgtatcattaatccttccgccgtagctgcccttttccaaaagcagcgtcctgcgctcggaacgtccggcataaatggctgctgacagccctgccggtccgccgccaacgataataagatcataaactgagtccataaccaactctcctttctatcataaaacacggttcctgaccatatcggctcccgtatcagcttcccctcaccgcagaaattccctgggccttttggtgtccgaacttgcctgctctctcccccacggctacccagataacacagattcctgtaaggaacaggcagtaaaatgcagcactgaagatctggaatggggacacggtcgggagatagctgtgcttttgcaccatttcattgataattgtcacactgcccatgacaaatgcactgttaataggaatgatggaactgaaattcgttgcattggctgtcaggaggatgctcctgcgctccggggatatgccgctttcctgtccaatcctgtccgccatgctgccgaacatcaggatggacggcagcacacagcctgccagaagtatattggtaatgatgattcccgctgtaagtatggtttcggcgccacgtgtggttcccatgatcttcctgcttaaaagccaggaacagcaccgctccatcatgcctccatccacggcaaccgcaatcagcccatacagcaggatagtggaaaccaccacatccagcattccgctgatgccttcaaagataacccctttcagccccgaggtgccatagtcaatggccacgatatccgatggggcaagaacccctgtcagaagtcccaccgcgaatcctgacacaatggcaaatgacaatcccatgaacaggttcccggtccggaaacagacgagcagcaggactgccagcgggaccagcatccaaagcccctgtggtgaggacatggctgatatctgtgaaatatcccccatggtgcctccgcgtcccccgaatatcagataaaccaccatggctaacccgcctgccgccaggatatagggagtcctcatcctcaatgtctgaagcaggtctgcaggccgtcccgtcactccgtcatgctgtatcatgacggtcgtattgatgacctgtgagcttggggagattgcatccccaaagaaaataccgctgatcaaagcccctgccagcatggcaggattggctcccagcaggattcccggcggataaaaaatgggtatcactgcaaacatggccgcaatgggtgcgccggcccccatggaaatcatggccgaggccaggaagctgaataccacaaatccgcttcttgaaatcccaagcttgaggctgagccagataaatccgtccccaatccctcctgtattcatcagcttggaaaaaatgccgatgaccatgaatacaaatatcagcctggaattaccatactgggcaagaccatggaccacgctgtcccaataccggtccttctccctgcagaggaaaaatcctgcaaagagggataccgccgccgcaaaggacagccccttcatggaataatagtgaagtccaactgaaaatgtcccgccgataagtatatatcccaccagcggcagcatggcaaacgcctgattaccataaaatgtaagtttggtttcctctgtcttcatatccttcgccccaatccgtcccttaagatagttaaaattataacaggctttttcccatggatatgttggagctccaacacttatgaaaattttataatttcttaccatcttttttatataagaaggacattaatacaggtatccggcggcatcggttcgtcaaaccaatgtcaatacttctattatatgttttattatccagttctaattgtgcataattaaccactgtttttcataagaaaaggactccccacatccggccggatgcctgggagcccttcctatatcacgttcgcttgtctttatatcatttgattgtctatttttcaacgttccagacagaacatcttcttgccatccgtcccgcactgcaccacgtggaaattaaacagattcccctctgtccagaactccattgcatccaggatccgcatgacagtggaacggttcaccacgttatccttttccatcgcaaacggggcaaactcccggttaatgaaatccgtaatctctgtgatggttaaaggatggtcctttgtggcatggttttcaagtatattcatgactagtaatggaaacatggtctgatgcacggtaatcttcctctctttctgcatcaaaaagggcctgctgtgaggccccatatttccattctgtattaatgggcgccctggcagtcctggttctctgttacgccaatccgtccgctgccgtagtgatactgataactacctgcaccggactgcccataactcaattccctgttaatgttcctgactgccatgatccactcatttcctttccacgattctttatacactttgccggggcgtatataaaaatccattccctgtgcacgtttaacagcgcacggtaaccccctgcatttcacagttacagtatatacatagtcctttttccatgtcaagtacgcaaatggaaggattcgaaccttcgggccggttacccggccaactccttagcggggagccgcattcagccactctgccacatttgcccggacggtgcatttgaaaaaaaggatacccgattcccaaatacacgcatgcgccaggttggatttgaaccaacaatgtttaccaccagggtcacggttttacagaccgcttgcttcagccgtttgcataccggcgcgtgttatcggttatttatgtttccgatgaatgtactataacacggtaacctgtgcagatatgcattattttgctgttttatgcagattttcatatcccggccttcacatccagcctctcaaacccaagatacctggttccctggaagctcagcttccctgtgtccccctctgaaagcatcccgtattccctgcctgtcacggacagttccatcctgtctccgctctccacctggaatgtcacataataactggtggacgaggtggagtggaatccatgtgcgccggtcatgtccccggcattggcatgcctatgatggctcacattggtacgctttgcagttaccgatgcgggcacggtcagccttggcgactggttattcttattccactgtccaatcccctttactgccactaccacaaacatcccaattacaattacaaacatcagggaaaaaattacctcaaaaccgcctccccagaaaaacgaatccataaacaaatgtacatccctcctgttccggtttatttccagaattttatatttacatagtagcacatcggcatgggggtctgttttacattttgtttaatataatctgactattttatatatgcgtgccatggcccgtgaccatggaaacaatctcctttacactctttccactgtatatcttcccatctaccatgatattaggggctgtcctgcactgtttcaggcatgcccttgttttcatatatatcctcccatcctgggagataccgtcaccgcctatcttaagccgctgcctcaactcctgcagcagcttaaggttatccctggatgcacagttttggcctgtgcagacagtgatttcatggacatacggtgatttcttcaggctgggataccgtttcattatgatttctataagggattccttcaccccggccgtctgtgccgcctcctccagaacagagggtccaatccatccgcatacgtcctgaagttccctcagcatgcttacaatgacctcctgcgaaccgcgttccggaagtcctttgtaataatccagtatttcccttacttctgtatctgtcttttcattatcacctgactgcatgtatactccttctccataataatgtgtaccatgatataatgcgtaccataacaccggaatttcccgctgtatccttttatttcccatctatatcttctgatgttccggattgttctattcattgtatcatgaagacaggggttcgtgcattccaaaaagcgtctttcccccctttatctggaaactttcaacgtctcatatatcctggtgtcatcccagtccgggtttgctttaatcatgtcataaattttttcaataaggtaaacttcctcttccagcatatccgcacacgcctctgccgtaacgccctttgccgccttcttccttacctgtttgattagcttcacggactcaccggctgcctcgccttctgcccttgcttcctgttgcagatatatcctctcttcccactcctgcatatacttcactccaatctcttcactggcttttagctgactgacccgtccgtgcagttctttgatacgctggctggtgctatgggatgccgcctggtctgtagtgtgctccatataatggagcagctctatcagttccgtgcccactccctccccattcgtcccatgggtatttaaaaatatcctgcttgccccatcctccaaaagcaatccttcctgctcctgacaggtcatcctgaaggtatacttatacctcccatatccccataaatcaaagggcatgatggatatcagatacgagggctgcatctcattaaaatcaatctcccccggcattagaagggagccgtcaatcagcgcctggtaaaacctgcttctcttaaccaggttccccgtattgattttctgcacttcggttgaatagacgcgccgttcctcatccgtcgtatacacatccagtcggatggagcgcagccagggcgctgtcctcaattccttctccacctgtggctgtccttttaattccagctcttttcccaggataattgaaagtattaactgaaggttccttttgtcctccatggtttccgcaaataaaaagcggtccaacagggtcagttctttaagccgcttgacggtctgcctgtttttcacagctatatccatatgtatctccttttattataatcaatctttccatctgttgcaagaaaatacagctttacacatccatgaaaccaccacctgaccattgaaccatattcttttatcacacattgggaatcacagggagaatatcccttaaagattgtcattagcagaacgccattgagaatcatatctataaaatatcacggaaccaccgtcacgtcaagacttgtaaaatagtcctgaaacttatttgaaccgcatagccaactcaccaatccaattccgccgcataagatatgacaaagcgtattatgaaaggttactgtatgtattacgacgactactatccttccgtgccggaagacctctatccttaccctgcagcaggttctgaattacagcctgatgacctgcagatggatgaatccatgcctgatgacctgcaggcggatgaattgctgcctgatgatttacaatctgatatggactattcagaagactgggttaattcacaggagtatgacccaatcatcccatatacagacagcccggaggaggaccaggtttttggcgcccctatgtccggacgcactgcccagcccatgcaggcacagcctatgatggcccaacccatgcagacccagcccatgatggcacagcctgcaatgcctatgccggacagaccggttgctcctttaccggaccggccggttcctcctattccggacagaccgaatcctccggtaagacctgacaggcccaaccctccggcaaggcccgacaggcccaaccctccaataagacctgacagacctaaccctccggtaaggcccgacaggcccacaccaccggtaagacccgacaggcccacaccacctaggcccattcctccaagacctgttcccccaaggcccatccccccaaggcccattcctccaaggcctgttcccccacgacctgttcctccaaggcctattcctcctgtggtgaaccctgactggtcatggaactggggtgtgatcctcccaggcacggttttcccggtttccattgcacgggtgcggttttacaatgcagcggtccgaggcccaatccagatttacgtgaataacaggctggttgtatctaacttaaacttcctggatttcacccggttctataatgtggcaccaggccgctaccgcataaccatctacaggggtaacaacatgcgtacgccaatcgtggatacctggatgtctttccagcgcaacacatccacaaccgttaccctggccggttcaggctctaacttctggctccagacaacggtacagtaataggcgcatctgccctaaaagggacaccgggctaagcctggtgtcccttggggcaggttggcattatatttcctgccacgttttactcatccggatttactggtcgcagatggagccgtcttcatacagccgtgtgttaatcttatgtggctggaatgggaacttatcttccacatcaggaatcagctcaattccaataccaggtcctgtgggaatttcaatatacccatcttttacatccggtatatgatttaccatatctttcatacacagatttttattgttactgttcataaacaggtcctgtgttgaacgcacataaggtgacggatattccgcaattgccagattatcaattgccgtacaaagattcagttcagcgttagttgccacaggacttaagggattatggggcaccaggctgcaatgatgtgattctgccagcgccgcaattttcatggcaccggtaatccctccgcaaagacatatgcttgcccttacataatggcatgcttttctttccaaaagcatttgaaattcaaatatattatgtatcctctccccggtggcaatgggaatccttgacatggacgccacctgggccatggcatcaaaattatcaggccggatgggatcttccaaaaacattggattaaattgttctagtttacctgacaacgcaatagccaatgccggttccagccgcctgtgcagctccagacataaatccatatccctgccaactgcatcccgtataagccccaccctttcctctgccttataaagcatagaactgcttccatcagaatacggtatgctggaaggttcatccaaaaacgggttgatgtgccctagtgctgtgaatccttcctcttttgctttcaggcaatgctcaatctgctcctctactgtcctaccagatatatgggcatatacacgtactttgttacggcactgcccacttaagagctgccacaccggagcattgaaatattttccttttatgtcccacaatgcaatatccaccgcgctgaccgcacccatgatggctgctccccgaaaatgtgaaaaacggtataggtattgccaatggtgctcaatctgcaaggggtccttgccaatcagatattcacggaatgttttcaatgccgcagcacttgcctccaggaatccccacgccccgctttcacctaatccaaccaggccattatctgtaaatattttacaatatacaaaccgatttgcacgaataatctgtaagtcctttattttcatcattcatctcctgttccctgtcatccaaacaaaccaaacaccaccccggaaatggcaagtacaatcgcacctccgattctggaagatatggatgcatatgtcataagccccatacggtgaccggcggccagaatcagcatatccccggaaccgcccatattggccatgcataatccacctgtaattgcagcatccactggataatatccaacaaaataacctgcaattgcgcttccgattatacatccaatgataataaatacagctatgcataaagttgtcactgacagcgcatcaatgaagctctggaaatccaatagggaaatagccataccgccaaaaaccgccggagccagtcctacattaataaacttatacattttgctgattccttttctcagggtgccgggaagaattccggtaacattcatgattactgctatgacaacaaggtatgcatattgatgaatggataccccaaggattttaggtagcagccatttgcttaacaggccggcaaatacccagcagctgaccatgatcagtaacccgttcccaatatcctgcatcgtacaggaatagccggacaggtcttctgctgcattctcctgctcgccctttgtccgcattaattgtgtaccgtctcctgtcagtttcggaaatttcttccctatgatgtctaatgcgaccgcaaagaaaatacagaggatattggccaccatcaatgccgacattgcaatcccataataaacatccttgtctttacctgtaacctcctcatatatactgctcattggcaatgcacccgcggcacttccaccgcccatgattggcatgacatatgtcatgaggatatcacctatatccaaaccaaaaaacaggacaccggctatcattgccataacagcggccccggctaatccgccaaggatacatggcagataaccaatcagggaacgaagcagggttttccgctcaatcgccatgactgcccctacaatcagcagtgtcagatagaaagcctgaaaattgattgtagccatccatgtattggttgcttccacatacttatcaggaatccagcctgaccatgtggcaaaggaaccaagcaataacaataataatggacctcctcccagatagtcctttataaccggcagctggtttccaactcccatgatgattccgcccactaccgtaagccagaataatgtagccccaaaatcagtccccaatgccccgacatacattccggcaaatactgagacagccatgattatccacagatacaccggcagccccatccatgtcactttatttaacttctccacaccaaaaagcctccttatgggatttattttcctgattttaaaaaacggaaccggccggtcctgattaaaatcaataatacaataccccctcattgacttgctttatttgatattgtattatttattaataattatagggaacagtacagcattttgtccaatatataatattggattgccccataaccacccacttatcgccaaggaggttttcatgtcttttgaccgtttggaatatgtaatgacaattgcagaagaacagaatatgacaaaggcagctgccaggctttttatttcccagccagccctgacagcctccattaataaattagaagaagaattgggagtgaaactatttgaccggcagcgcccgcccatcaagttgacgcaggccggcgtgctgtatataaaagagatgagccgtatccatcagcttcagttcaatctcaaagcacagctttcttcctttgcaagaaaaaagccccagttcacaattgggattggaaaaggacggagccagttctggcttcctattttactgcccatctttcaggaattgcatccggaaatccagattattgtaaaaaacggaaattatgatacactggaaaatacctttcattcgggttctatcgatattgcttttggatcccttaacttttcattttccgataccgatattgtggaggagcctttatcaaaggagaaccttatctatattgttcccagcaaattagggataatcaatgatatggaatatggtgactgctcattatacaacccatttctgatttccccatccttactgaatgagcagccctttgtctgtgccgaatcaggaaacagctatcagcggtatctggaaatcgagatgaacaaatatagcttccgcccaggcgatatcttcatctatgattttcctcccctcgcagcccaattggcaggaaaggggatgggtattttctttacatcacagagcctctgcgaatgggaaaggcttgccctgaatagcaatgtatatttctgcacactaaataacatcatgcccaaccagaatatccgtgtatactataacaggaacagtacaaaactggatttgattcatgaagtaatctctattgtacgtaatcatgtgattcctgccctgtatccaaatacagccagccccagcatcatataacccccttctgtttcctatactccgacaccgacacatgataccgccgtttaaacagacaggagaaataattggcattgacatagcccacccgttccccaatctcatatgtcttaaggctggtgtgctccaccagttccctggcagcttccatccggatttctgacaggaagtcggaaaatgtaacctgctttatcttcttaaacaggatggacaggtagaccgggcttacgtggagttcttccgccacatcattcagggacagctcactgtccggataattattccttatatacgtttccgccttgtgggccaggactgttttggagtctgcctgtgtctcgttaacccctgcgcagatatcacggatcaggtccgccacaatcccgaatatccgggacaggtctgaactggcgcatatcctgtcacagtattcatagtaatcatggcttccttccaggcggctccagttccctgtttcctgcagcagatgggcgataaggccgatgcaccacatgcggaggttcccaagggtgattccttccttcaggaccctggccctgcactgctctaaaagccccagggcctgctcacggctgcccagcaggactttctggataagcagcttatttccctcgcccagctctgcccttttcccggattcccaggtcacggcttcatgaaatacggagtaaccctcccgctctgataaatgtctgtattttaaggctgtgaacgcttcctgtatggagtcctccagccgttccaggccagaataccggtttccgattcccagcgccgtctccacgtccagcacctccagtatggtcccacggattttccctgcaaatcctgtcccttgttcctccaggccgcatcccccgtcctggctggacaggatgatatacacatggtctgcatttccctgaaagacttctaccgcacagccatccacggactggctcagctcctggacacagttatagaccgcatatttaagaagctccccccacagatccctggtcctgtcataatagtccacaatcagcaggtccagggcaatcaggttctccttgtatatcttcagccctaattcctgtatggcttcttctatcctggccttgccataataacccgccatcaggtcattgatgaactggcggcttaaaagcggtatgcttttattcttccggtgggtatccctcatacggctttcaaactgcttctttgtgttcaggaccgattccaaaagttcctccctggccaacggcttcaggagataatcgcatgccttatgcttaattgcctcctttgcatactcaaaatcctcatatgcagtcagaaggatgacctggatatccggataaagaatgcgggcctccttcataagctcaatcccggacatctgaggcatcttaatatcagtcagcagcagatggggagcaagctcctttagcatggaaagggcttcctgtccgtcacatgcaacccccacgatttccattccatagctttcccagtcaattgtctttttaagtcccctgcggatgatggcgtcatcatccgcaatcaatacacggtacataaaacctcctttttcaacagccgggatctgttccagggatttcaggtcacagggatatacacctttatgaccgttccccgcccctgtacgctctcaatctccagcccggcttccccgtcataataaagcataagcctggaatacacattcctcagcccaaagcttacctggctgtatccttcttcctgattcatgctttttcggacctgctccagccgttcactggccattccagctcctgtatcccttacctcaaacaggatacgcccgccctcacgcttcccggtaatggtaatcataccttttccggcctgattctgtatgccgtggtgcagcgcgttctccacaaggggctgcagcgtcagcttcaggatacggcagtcccgtatatccggggctatctctatttcatattcaaatttatccccatatttcatgtgctggattacaagataattttttacatggttgatttccgtgtctatggttatgacatcttccccccggcttaatccggtcctgaaaaaattggacagggccaggaccatggcgctggcctcctttgattcatccagttcacagagctgctgtacggaatacagcgtattatacagaaaatgcgggttaatctgttcctgcatcagggagagttctgcctcccgctttttctcctgctcctcttttacctgttcaatcagctgccttaccctggacagcagttcattgattttgtcgctgaggatctgtatctccctggcgccgcctgaggagacattggcgattgaagtgacgtcctcaacggatacggtgtcggtcagccgtttgatgggcagcacgatcaggcggctcagcaccacacaggccagcacgctgcacacaatcactgcaatcatggtaaaatgaatggagttctgcatcgtgcgcacatcgtggaacatttcattggttggcagtaatgcggccacaagccagccatttgtcttcagatgccttgtatataccatcatttcctgcccggagacgctcttaaccttgattccggcggatacatccgccatctgctggagacggcgcagggactgtgccgacagcgtataagactcatccacatccttataacgtataaggctgccgtcatggatcagggccacatatccattttcactgatatccggtatggtcagcatatcccggaacatggattcccggatattaaacacaatcccgccccgtccgggctgccccggcttgccgtacagcctgtacagggagaacacccggttgttcttacggttgttttccgcatccgtcacctggaaaatggtatcgtcgtgaagaaagctccagttatagatggactggttgcgtccataccatgcgtcgtagttaaaatcaatctttaccggtatatcctcacaccggtacatccggaaccggctgtcattaaaatcaatgattacggaatccaggaaggaaccagatgacacaaactggtcgtcaatgcttttcctcaggttgatataatactgtcccttggccctgtccacattttcctgtgacatcacaagggcaagggacagcatgtcactgctgttctcaatgtactggaaccgctccatcagatccgccatacggctgtcaagcacgctggttgactgggtcagcgaattaagcatgttggcccttgagctttccgtcacctggttatatgacatgcgctggaacgtagtgcccataataaggattgtcaccaccatcacgggcacgaacacaatcactaaaagccacataaccggtatatgcttcattgccgttttccggccggtgtcaaatcctttcatctcattcctgctcccaatcctcaattaaaaacagattacagtgtccttcatccgtatcagccgcatacaggatcttacggccgtcccagctgaacgtcgggtggcagtgggagtgctggtacagccatgtggtattatggtttgccagcacccggagggttggtttcccatctgtccccatacggatcaatacgatatcatccgttccatcccccacgaactcatcctttaccggattggccatgtaatggttacagtaaaaaggcatggggaccgtcctttgtacctgtccggttttatccgcaataccgaaatagggctgcctgcctcctgaggaaggcggcgtgaatacctgggtcctgtccgaggaaatggtgccgtcatggccggctccccggttgtcgaacacaatcatcccatcccttgtccagaactcgtgtcccacgcagtcgtcctccccctgccggaaacagggccacacatgcccattgtccatgttgataagccatatcctctggttcacgcagttccacggcccttcatggcagaacatggcaatggaaggattgtccggggaaaactggaaatgcgacagccagttggtatccctccacacatcatggaaacccgtgccatccatgttgaccacggaaatccggctgtccttgattgcatacattttatccttaaatcccgaataattagggccgccgtcctgcctggcccccacatcctcattgcgtatgaacccaatccgcttcctgtcgctgctgaccgagaaattctgtaccagcatgtcatggtcttcatataccaccttcacggtcttttcccgcgtatccatcacctttaaacggcatccggaccagtacacaagataccggctgtcccttgtcttggtggccgtgctcagccagaccccctccggctcatccgttacctgggtcatcacgcctgtatccagctccatatggaacaggttataaatacccctgccattacagcggtccgagaaaaagtatatggagttactatccccatcaaaggaattatctgtaaaatacatatggaaattcacatgtctgtccgtcagctgtttgatgcgcagcccgctttttgggtccgtatactcttttatttctgacggaaacctgtctcctgtcatggctgtcccctttctataccatttatatcacattttttccctcacatccagaagttccggtatctgcaggtccatggatgcaaatgcatcccgtatccgcgccgccttgctgcacccaaggatcaggaaggtctcaaattccctggtcagcacatactgtatgaccagggatgatacatcaatccctgtccgaaggctggcttccctgaccctcctggcccttgccatattttcctctgtcagatattttttccttgtgtcttcattcagtgcatcctccccctgttccagatacaggctgaaaaagccctgggcctgggcggaataggcgtacagaggaatatctgccgtcctgtaccattcataggatacaggatccatgcagataacggattcatccccccatgcctcaggtgtacagacgcccaatccaaactgtatctggctcatggagaacccctgtttccccgccgccccagcataggcattggctgcctggatccgctccgtggtccagttggaagcgcccacatagcggaccagtccctgacggaccaatgcatcacaggtatccacaatctcctctaccgggcgctccctctcatccctgtgaagccagaacacatccacgtatcctgttcccagggcatccaggcttttatggagttcttcctccagatgggaacaggacagacagccccggtccctgttatatcctcttggcatcagtccgcctttggttccgataaaaagagtttccctcttcccgtgttccttcagccacatgccgatggcctgctcgcttgtaccgtcccggccatccagccagctggcatagctcctggccgtatcaatctggttcccgcctagggatgtatatacctggagcagcttagctgactctgtcctgcttatcctgctgccaaaatacatggtccccagcgctatggtgctgacgggggtaccatccgcacagcagaacctggaactgtatctccggtcattgcccgcctgtccgcggattcctttatcgcttcgcatgcctgcactcctcccaaagcccggccatgtaatgcaatggattatggcccagataatccctgcagggcatgttaaacccggtctgcggtttcctttgtacctgttccggccgtcctccaagggaatcatagaattcccagatacagccggtctgggaataaatccgggaagtcccgtcaagggcggcttccagcaggcgccctgcctcctcatatctgccatacctcatacagcccctggcagcccacatggtcatggaattccaggcagggcctctccacatccgtttctcatacagggaatcctgcagggagacggtagggacagggtgccgtgacaggaattcctgttcattcatcatatggcgctcaatgatatatccggcctgttcaggatccgcggcccccacaatcaccggccagaagccttccaggcacaggtgcctgtatttgggacagtccacggaccaactgtcatagaagaaacctgtttccctgtcatacaggacattccttatatactgtcccaggccatcccttttttcctcaagggtcctgtccctgataccgtacagttcctgctgccatgccagaaggcggtcatacatgagatatacgtgggaacaggcatccacacaggacttttccccttccgggacctccatgaaccggattccctcatccacgccgctttcccagagatggtttttaatatccgtataataaaagcctccgtccattgccctgcggctgtgttcaaaccaggacacctggcgttcaagggcatccgcacaggttttcagccacgccttatccctgtttctcccatatatcagatctgccgcagatacccacaccgggggatgggtctggtccggcgcccagtccgcaggggcatcctccctcatccatatgatacttgggatcatgccgtcctcctgctgaaggcttatcaggttgtcaatctgatacctggcctgggccggatcatcctcaagaaggtccagggcgatgtgcactgcatcccaatgtccaaatgccgggccgtagcagtagccagggccgatatcctcccatggataaggcagcacgccctggggctggaactggctttttccgtgaagcattttcacatagtcaagcactggcccccattcacttttaccgtaattcatgactttcctcctcttatcttacatggacaggaagggatacggattcctgtcatccgtatcccttcctgccgcctgttatttcttaatcagctgcgtatattctgcctccgcacctgtcatggcatctgcccattctgtcaggaactcctccgaggatttctgtcctgccagcactgcctggaatcccggcgctgcaatggaatcctggatggactggtaatccggcagatacagaggatacgggaaagcaatcgtattgtcatcagactgcatcttcattgcctcattgatgtgctgtgtgtttacgacccagtcttcattggtcaggtccgtgtgggtaggcacctggccaatgttctggttccagtaactctgtgactccgcggagcacaggaagctgatgaacctccacgcctcatccttgacctgggactgcctgaacatgacatagccattgaccggatagccgccggaaatcacacgtttccccgtggctgatacaggcggtgcgaatgcaaagaacttaccttctcccagggtcttgctgtgttcgccgaaggaacccaggttatgctgtatcattgccgcacttccagtatcaaaggcagctaccatttccttatatccgttggaaatatcgctctccggtgtgtacttgttatagatatccttaagccggtccagggcctccacgttcttcgggtcattgagcgtggatttcccatcctccgtaaatggctgcgtgatgccggaatatgcgtacaggtattcctgaagctgcatggggccgcctgccccgccgcggatgctgaacccgtaggtgcctgcatcgctgtccgtaaacagttcaaccagatcatagaagtcatcccaagtcccgggcgcctccacccctttctcctcaaaccagtccttccttccccagaacatcgggttaaaggtggatgtgttaggtatacagtacagtttgtcatccacggacaaggtgcgcagggattggacgatggactggttaatcttgtcatgttcctcccatgaatcaaagtacgcatcaagtggctccagggcgtcatttaagatgaatcctgcctgccactggggcggcatgccgcacacatccggggcagcgtttccggttaccgcaacctcaatcttgttcttcgcatcactgttgggaaggcccacatactcaatcttgatatctgggttctgctcctcaaaccgtttaatcagctcctcataatacggcgtccggttgggacctgcattctcatcccagaaaacaacggtcttaacctccccggaggcagcctttccattatccgcttttccggcatccccctttccgtccgcgctttcaagagcctccgtggcctgtccggccggggcagccggcgcatcctccttggaaccgcatccgtacagcatggaacctgccatacacacccccagtgtcactgctaataatttcttcctcataatgaacctccttatccttttacagctccggccgtcaaaccgccgaccagatacttctgcacatatatgaacatcagaatcgccggggccagcgcaatcatgcttcctgctgccagcgccccatagttaatatcaaattgtccctgcatgaacgaaagacctaccggtatggtgaatttctttgtattgttcacaaacatcagtgcaaacaggaattcattccaacaggatataaaggaaaatgacgcgcacgccaccactcccggcgtcagcacgggcagcaccaccttgaccagggcctggaacctggagcatccgtccacataggcggcttcctccagatgatacggtatcttctccacaaaccccttcatcatgatggatgaaaatggaatctggaatgtggtgtaaaccaggatcagggaccagtggttgttaatcaggtgcagctttgagaatgtaatgaacagcggtataatcaacatggcgctgggtatgaactgggtacataaaagcaccagcatgaacggctgtttccctttaaacttaaatctggacagggcatatcccaccagcagtgcgctggccaccgtcatgaggcaggccacggcagataccaggaggctgttaaggaaatactgggaaaagcccacatccctccaggccgtgacataattcatggcggtcgccgggtcaggcaggtagcgcacaggccgcttgatgatgtccccctccaccttcagggacgtgaccaatgtccagtaaaaggggaaacagatgaaacccacaaacgcggtcagtggcagcagacggtatatgattaaatccttccatttcctggctttcatgccttctcctcctctccgaatcctgtcagcttaatataggctgctgcgaacaccgccaggatgacaaatgaaatcactgcaatggcggatccgtatccaaagttactgtccctgatggctgtctgggttatatacatggtcagggtcatggtacggttcaccggcccgcctcccgtcaggttgtagattacatccacattgttaaactcccacacagcccttaaaagggtggacaatacaatggtttccttaagatgcggcaaggtaatgtagaggaatttgctccatctggtccctccgtcaaccgaacacgcttcatactcctcatccggtatgctctgaaggcccgccagaagcatgatggcaaaaaacgggataccgcgccacagttccgcaaccgtcaaggctgcaaaggaggtgccgtaaccggaaatccatgcaatccccttcttaatgatacccattttcatgagaaagtcattgaccacgcccatattctcattgtacattaacgaccacatcatggatgtcagcacgcctgacacggcccacggcgcgaacacaatggcccttaagatgccacggcccctaaacctctggttcaggaccagggcaatcataagcccgaataccagctgaagccccacctggacaaccacccatttaacagagacaaggaggctggccctgaaggtcttatcctctgtcaggatttttatgatattgccaggccccacaaatcctctcagataaggcttgttggtggcatagttctgaaggctgtaataaaacacgttcaggatcgggtatgccatgaacagcagcaaaaacacgattgccggcgtcaaaaaacaatatggcaggtacctgcttccaatcttcttactcatatcctcattcccctcttctgttccaggtcatatctgaactgtaacattatagtaccggataaaaggaaaatttgatatgaaataatttatacaaaaatctataatatttttatgtgtgtgttccgctattgctgccgggacttccgattgtttatctgaatccggtatgctagaatataatcagatgaaacagaaaggggtgggaagatgaggattgcagcttccaggtaacagtgcagggttcctgtcaggggccttgctgattgacatcagattaggaggccaatatgtcatattttaaatatcagggaaaaaatatccattacgaagaaacaggcagcggcaggccattactcctgcttcacggcaacacggcatcatccaacatgttttatgagatagccggcagatatgcagggcatcacaaagtagtcctcattgatttcctgggacacggaaagtcggacaggctgacagagttcccggcagacttatggtttgatgaggccatgcaggtcatcggacttataaagaccaggcagtacggcaaagcagatatcatcggcagcagcggaggcgccctggccgcaatcaacgtggccctggaggcgccggaactggttgggaaagtcattgccgacagctttgaaggcgagactccgctgaaggcatttacccagaacatcgaacaggaccgcgaggcatccaagaaggatgaaaatgccaggatgttctactattatatgaacggggatgactgggaacatgtggtggattgcgacacctccgccatccgccggcatgatagtaccatcggtaaattcttccacaaacccctggagggcttccagccggatatcctgctgaccggaagcagggaggatgaatttatctgcgcccttgaaacagactactttgaacgggtctatggggagatgatcaggaaaatcggccatgggaaaatccatctgtttgacacaggcggccatccggccatgctgtccaaccagcagggattccttgagataagccgtggttttttagaggaataaacagcaggggccagaggagcaatcctctggccctgtctgaatttcctttatgattgtttcctagtgctccatccagccagaaactgtactgccagtgctgaatattttgtcagcctgcaaggcggaggaaggaagcggagtgggtcctccgctgactgacgacaacgcggcagatggcaaaataggcagtgctggaagtacagtttctggctggatggagtactaatcccccaaagaatatactgccgtaaaatatcctcttgggttatagctgagacagtttccccccagcatcccctgcacgccgtccattccctgccccctgtcagaaggcagtatctcctgctgggatctggatgccatggcaacccctgtataagagccttcgaccgcgcccttcaggatatagatatccccctcatagattgtcttcatcaccgtatccgcgcttgtctgccacagttcataggtaccggaaccgtaatccagggtaagtcctgtctcttctccactcccggacggattactgccttcttcatacagcacatatccgtaaacggtttcctgcccttttgttcccgggtccagcgccagcatcctgtgctcaccggtccgttcattcagcacaacctgaacttcccctccatccgccataagctttacctgctccgccgtaatggccgcaggtatggaaatgcttccctgtacaacataatacgcccccatatccctggcggtcgataaatccgcatacagtcccgtttcaggatgattacccagcagggatagataaggtgcaaagggaaggtcttccagtccatactggttctgcccgtccagacggttcctgtccggattcccctccatctcttttatgaaagcaatattattcttttccacatcggataggagggattcggaaaatgcatccggctccatgattccccggtaccacatcttaccggaatagtattggttcagtacatcggatttgaacttcctgccatgggccgcataaatctcattcctgagcagcatcaggtcctccgtaggccacaggcataaatcagctttgcagagatttctggtaaagacatccggaaatgtgaagcttccctcccagggatagtaatcccctgcaaaagcgccgtttccctccacagagatatgcctgtcggtcagatccggggttaagtggaaggctaccgtataggatggattccctgcttccgtttccgcgcctgcaagatattcctgaggctgtacctcatatgaaagcctcccttcctccgtcaggaattccgtactgtccataacagaaaaggcatcggcataatcctgaatcaggaaactgcattccagccattctgtttccatgccgccctttgccggacggagggaaatgcgccgccggatatcccctgcctgaaagaaagtacctgtaaatatggtattatccgtcctcaggtttcgggcagctttgctgatgacatattgattttgggtgattggccgcccctggcctgaatctgattcccggctgcctggctggccctggcctgcctgctggtcattgccccggctctggtctatattccggccgcttccctggctctggtctgcattccggtcactgccctggctctggtctgcatccttcccggcatgacccgtgccatcttcccatccttcctgccctggctttaaggactgttccgtctgctgtcccccacccgccgtaacatccaaaccagattcttttccctggcaggaaaccagtaccataccggctgccagcatgtaacccaatacaatctttcttttcatccaatcaacacctgcctgtcttctccccataggaaagcatcctctgtctgcatccctttccactgttatgcacatatgaacgtcaaaacacacttaaatcttccaggaaggcagattttcaattgcgtcagcagtctttccgctttccatcgtcacttaaaagtatactacagacatcagaaaaggactattaattttcccttgcagaattcttagggtgtgtttgaaaattgctttctgtcagccgtgcgtccgcgtacctgacagcagggttaccttataaactcaacccggtccacggttgccggattaaccagcaccttaaactccttaaccgtaggcgtatggtaagaacttatcttcctctccttcagctccttcatgatctggtccttacagtccatgaacgtcacaaaatcatcggagatataataatagtcaacccaggcagtatccccctccccgcattccagatacggtcttatggccttggaattataggtaagctggaacctcactgtattctccggcacatccgggtcctggaccagttccttttcggattgggattccccatagtaatagccaatccgaaacttttcttcttcctttggttcaaacgcatactcaaaggattccgtcttcatctccaccggacctgcttccttttcccccatgtaagcaaaggtggaggcttcataggccgcgactccggttcccagtccggtaagaaaaacaccaccgcagaaaatacctatcatgactttctgtaaattacgcatgccttacctccttggaaatcttattcatgcaggtttcttcctgatatccacgcaatgatgcctgcggtctatcttccggcacgggcggttcctgcggtcctgcctcctcttccggttcagggtgctcctgccgcccggccttttcttccgaatcagggtactcctgccgcccggctttcccttccggccccagacgctcctgcggtcctgccttccattccggcttagggcactcctgccgcccggccttttcttccggctcagggtgctcctgcccggccttttcttccggccccaagcactcctgccgcccggccttctcttccagttcaggccactcccgcagcccggccttcttttccggctcaggccacttccgcagcccaactttctcatccggctccagacgctcccgccgcctggcctcctcttccggtccagaccgctcctgccgcccgtctttcccttccggccccagacgccccttccgcccggccctctcttccggttcagaccgctcccgccgcccggccttttcttccgccccagtccgcacctgctccccgtcctgcatccttatccgccctggcctggcctgttcccaacagcattcccgccctgtcctcagccgcaacaggctgaaacacagatatgtaactgaaccaaaacataagatcgttcccagactgattaacgtaatacccagcagcggataaccatgaaacagccataccacggatgcgccaaagataaatatcatgcacagggtgaaggagcctccaagaagccccaggaatatcatgcagatattaaaacaccagcggatacaccacagcgccatccagaccagaaaccggaaacagtgtcctatgaatgaaccaataccctgtcccacatctctgatacaggtcccgattcccagccttaacaggcctctgccccggtccgatctgcaaacacccatgtccctgtcagcctgcgcccttctgacaaaacgttttataccgctcccctggagacgtccgccttccggacgtgtatcctcatcctgtttccggctccttatcctgtttctccatggcgcggacaggaacatccatatgcgtcccgcgccctgcctgactgttccggcacagatgcagaaaaacctttttaccctcgtgccggtccttccaaaaaagccggacgctgccgcccatgcctgtttcccttttgcagcagctgcttgcgtatccaccttcctcttaacagacgtttggccctgatattccggattcacatggtatgcctcaagtatcccacatgcaagttcccggatatctccaaagtcccggattgcctcttcttcacttaatccattttcaatcttcatgtcaatatgctgggtgtattcctccaatatatcctgctgttccttatcttcaagaatggcaagatatgtccccagttcctctaaaaatcccttcttattcatccttctgctcctttaaaaacctgcacacctgtttctgaaattcatcccattcctgctccagccggtccctgtacaggattcctgccgccgtgatatgataatacttccggggcgggccctcggttgattcccgcagatatgtctcaaaataccgttcattggtcagacgcttaagcagcgggtaaatggtaccctcgttcacatcaatgaccttggacacctcctctaccagctcgtacccatacatgtccttcttcctgacagattccagtaccaccagctcaaggactccttttttaaactgtggattcatggccgtcctcctttagatactatattatacatactactatgtaatgtcaagtactatgaaaaacaaaatacttaaattttcattacgcctgagataactgtcatggcttgatttccatccctgcttctgttatgataaaccgcatgaaagaataggtgattacaatatgaatctgcattttcaaccaataacagacaagaacagggaaaccgcgcttaagctgcgcatttccccaaaacagaaaggctatgtggagacggtggaggaatgcctggcggaggccgcacataacaggaactggaggcccgttgggatatacgacggcaacgtcatggtaggttttgccatgtacggcttcttctggtggccatacctcccctttgggcgcctgtggctggaccgccttctcattgatgaaaccttccagggaaaggggtatggaagtgccgccctctccggcctcctgaaccgcctgaagcaggaataccgatgctccaggatcgatctgagcgtcatcagggaaaataccaccgccatcaccatgtatgaaaagtccggcttccggtttaacggcgaacgggacatacacggggagcatgtgatggtataccaagtaaaaaaacaatgagcaggcagcccgccgggtcacctgctccatctataatcatagattgattctttcattccgattgattttttcattcagctttctgtaaacccgttcacgcatccacggttccgttgaagcgaggacggcatccccaggtaagaaccatgcgacgccgctgttctcatcctcttttatgtgcagtccttccccctcctccgcctccagcagataggtcacattcagatgcagatgggagggcacataagcgccctttttcacatgaccgtccaccgtcaggatttccagcgagtaaaccgcatccgaaacaggccgcacctgcttaagcccgctttcctccttcacttcccggacagccacctgtaaaagatcctgcaccccgtccgcatggcctcccagccaggaccaggactgatagatgttatggtatgccatcagcactttggtgcgctgacggtttacaacccaggccgacgcggtcatatgcgccatggcattgtcccgtgtgaagatatccttttcttccttcaggcatctgataatgatgttcctgtccctttcctcctgctcattaaaaggactgtattcctctaattgccttaacagatccatcatagtccctccagcggacccacgattttcccggccgctgcacaggccgcggcggttctgggtgacgccaggtaaatctccaccttggaagtccccatgcgccccaggaaattgcggttattggtggcaatgacccgctccccatcgctgaggatacctccggtccgcccgcagcacaggccgcagccaggatgtgtgatgattgcgcctgcctccgccagggtatcgattgccccgcaggcaatggcctcgttataaaccttcctgctggccggcgtcactatcagcttcacatagtccgccacctgcctgccctttaatacctcagccgcagccaccaaatcctccaggcgcccgttggtgcatgagccgatgaacacctggtcgatgggcgtgcctataagctcactgaccggcttgattttgtccacctgggacggacatgccatcacaggaacaaagtcctctgcccgatacaccattgtcttcatgtacgcggcatccgcatcgcctatcaggctcttctggtaatcgtccagtttcacttcacagtattcttccgtcttggcatccggtgtgaacaatgcacatttggccccggcttcaatggccatgttggcaatggtcatacggctggcaatgctcatctcctccaccgttgtcccgctaaactccagggcacggtaggttgccccgtcagcccccaggtcgccaatcaggcgcaggatgatgtcctttgacatgacgccctcaggcagttttccgtctatgaccaccttgatggtttccggaaccttaatccacatggtaccggtgcccaggatacttgccatctccgtataaccgataccagaggaaaatgcacccacacatccataagtggtggtatggctgtccgtgccgaacaccacgtcccccggtttcacataaccggcttccgtcatcagctggtggcagatgccatcgcttctgtgcacatgcttcatcccgtatctggccgcaaacgcatcccctacacggaaatgcctggtatcatccagctggctggccgggaccagatggtcgtagataaggaccaccctgtccgggtcccaaagcttcttaaatcccatctcttcaaacttatccgccacaaacggaatgaagatatcatgaatcatcacacggtccacattcaccgtgacaatgtcccccggcctgacctgggcagcgcctgtattatgtttaataatcttttcaatgattgtatttcccattgcagtctccttaatccccttaatccagtccgttcagtttcctcatggctttcaccagtccgcctgcattgatgatatccaccaggttctggggcagggatgcaatcggatactgccttcccttatagtccacatggtgattcactgtaaccgttatggggtccccctccgtcatatcatcatacaggtccggctgctctatcaaaagcaggccgttattaatggaattacggaaaaatatccttgcaaatgacttggcaatcacacacctgattcccagtgccttgataatctccggcgcctgctcccgggaggagccgcagccaaagttcttacctgccacgatgatgtccccttcctcaatctgcccagccagttccgggcgcaggggactgaatccgtactgcttcatatcgtcaattgtcttaagcgccagatactcggttgggatgatgatgtccgtgtcaatgtcatcccccagcacccagactttgcctgtaaatgtctccatttttctatttcctttcctgtgttgctgccatcacaaatccggttccggtttacataccaagccgccccctggtactggccgtctatccggcctggtattgtttggtgattcattcccgccatctgacggaaagcattttcaaacacatcccagggcaatctcccccgcaatggcggaagccgtcactgttgccgcggaaccgagatacaccttggagcttggatggcctgcgcggcccttgaagttcctggttccggtgctgatcagtacctcattttccccaatcacgccctggcagcttccccagcacacactgcagttggggttcatcacaatggcccctgactccatgaaaatgtcaatcaggccttccttaagcgcctgcctgtatacctcaaggcttgcgggaaccaccaggaaacgtacgctgtcagctacctttttccccttaagtatagccgcgcccacacgaagctcatcgatgcgcccattgttgcaggaccctaagaatgcctcgtcaatcttaacgccgcaaacatcctttgcaggcaccacatcatccacaaaatcaggccttgcaaccaccggctggatttgggacagatcaaaggtatactcccgtgcatagacagcatccgggtcactggtatatacggccttcggttcacgcccccgctccctcagataccggacagcggcttcatctgcctcaaaaatccctgtcttggcccctgcttccaccgccaggttgcatagaaccatacggtcattgatgctcagcgtcttagcgccttccccggtgaactccattacctggtaattacatccattggccccaatctccccaatgatggtcagcatcaggtcccttggatagacgccttcctgcaggcggcccaccagattgaacttcactgtctcaggcaccagcacccaggaagtgccggtaaccatgccgtagagaaaatccgtgcatcccaccccggttccgaaggcgcccagcgcgccgtacgtgcaggtgtggctgtccgccccgaatatcagctcgccggaacatacgtaatgctccatcatgatctgatggcagaccccctttccttcccagaaatcaatccggttctccctggcaaaatccctcatctttttctgtgaggcagctgtttttggattatccgcaggcacattgtggtccacgataaaaaccagtttcttatggtccgcaatcctgggatgtttcaatttattgttgtacatgtcaacggtcaggtgggtggttccgtcattgctcataagacggtccaggttcacggtatggatatcccccggcttcacactgtccacccctgccgctgctgcgatgatcttctctgcaatcgtcattcccatgtctacgcttcctccttgttcaatgatgcaatcagcccgccctgattcaggatattctgcatatactcaggaagtctggtacatgcatactcctttccattggcccttgccacaccctcggacatggacagttccatggtatccccggtcttcacttcatccggaagttccttgcagacaatcacgggaagcccgatgttgatggaattcctataaaatatcctggcaaacgacttggcaatcacagccttgacccccaaagccttgaggacgctgggcgcctgttccctggaggaaccgcatccaaaattctcgccccccaccacgtagtccccttcctttaccttccttggaaaatcagggtccaatgattcaaatgtatgtaccttcatctcatcgatatttggcaataagagatattgtgaagcaatgatctggtccgtgtccagatcgtcatgaaatttaaaaacagttccgcccggcataaggtaatccctcctgttaaaagttatacttgttactcatctgcttatctattctaccacagactttgctataataataatacatgataagaataggtactatagatacagattatgaaaggggacatccacccccataaatccgcaaaagataaggcatatataggaacatcctgtccttatatgccttatccatatattccttcagataaacttaggaacaatactgtccatcaggattctactttcagacttaacgcattaagaaatttgatgatatctgactttgctccgattttgcttttatgggtttcaatgtaatatccatcataaataataggggcaaaaaatgccctcccgcttatatgctttccgtctttactaatcagatatcttttgctccctgttttaaaaggaaccagctgttcgaactcaatgtcatttgccgtaaggtaatcaaacacattccgataaaaagatttgaccgtattcgcctctatcctaaatccatcgatgattaaacttatcttatcttcatcatttacaatatcaatttcacttaactgttcttgtgctaaatcaattttttgctgaactttttccctgatatcctgagggaccgtactatcattagccacctcattccccaatatgttcagtttctgtctaatggcctgcaaaaaattgttatcatttttgtaataatccggagaataaaaattttccggttttttgtacagcacaaaaaagaaaagcaggacaatcagcaccggaaagcatatgacaaaccacacaaatatcatctgaatattgtttggaagaaatttcaataccacggtgccaaacacttctgccaaagatgcaaaaatagcgattatccctaaagggttctgtttattatgattcatgagtaactttcccgctttcattggttatcattccacccgtcaccgtcccctcccggtacacacaatacctggagcgtccctccttctttgcctggtacaaagcctggtcgctgtgctggatgagcaggtctatatccatatccccgtcctttccctgggcaatgcctatgctggctgataaggattgcatttccctggatgcctggaaccgggcattaagcttatcaaggaattcccctgcttctttttcaagctgttccatgctgcactcaccgagccttgccaccaggaactcatcccctccaagccttgccacaaaatcatccgggaaggattccacaagcatcctggctgtacctgtcagcaccgcatcccccaccttatgcccgtatgtatcgttcaccgccttaaaccagtccaaatcaatgtaaagcaggcttacggccctgtccccgcggttatgattgatatactggtaaaaatacctgcggttgtaaagccctgtgaggaaatccgtattggagctgtggaggatctgtttttccaggttccgctccaccgtcacatcccggaagatgcagagcttccccactacattgtggaatatgtcatagatggagctttcgtggatttccagcattttcccagtcccgtccggcagggataccctggcctccgcatatccctcgctattaactgtgcgtggtccgtcaaaggcatccgccaaccactcctcataatcctttcccaggatctgaatcttacttatctggaaatactcctcgaattttgcatttgcattcagtatcctgcccctgttattccataagaggatggcataaggcatgctttgaagcaggatttcgatttccgcgctcatgttgtgcaggtccgtcacatcatggccgattccgaccgtcccaaggaccgtcacaccgtcccggtccatgataggtgtcttataggtgcgcagctgccgcattcccctggaacatttgacctcctcggtaaactgcagggtacgccgcgccaggatgacagcatcctccgactttttacaggattcctccccattttcaaagtcatccggtgaaacgccccagatataacagtggtcccgtccaaccacatcctcccggtcctttcccaccacggaacagaatgcacggttcaccttgacatgtgttccgtccatggccttgaaccagagcatgtccggcaggctgtcaatggccgtgtccaggtatgtccgggtcatatacaggtcatactcaagcttaatctgtttcaggatatgttccatccggatacgcacccgctcctgcatgagcgggatgtcccagaactcgtccgccgcctccatctcgctggcggcaagaccgtcaatcatcccccgctccccacagtacacaagaaccgcatcctccctgcaatgtgaacgcagccctgatggaaggatgccgctgcccaggttccagataaccacatggctgccagcagcccgctcaggcgaaaattcccctgcttgcgtaattgtatgtgaaaaatgttccagcgggcaaagacggcgcatcaccccggccagcattgaatccctgctgaaaatcatgatttgaagcttacattgatacattgtacccctccccctgcagacaccagcccctgctataagcccctgctataaatacagcttttcaaaccccgaagcgctgaccggccttccaaacagatatccctgtatgtaatccggctgtgtctgctttacaatatcaaattcttcctctgtctccacaccttccacgcagacctttaaaccgatgctgtgggcaagcttgatgatatactctaaaaaaatgtattcatagcttccctggtggatacctgtcacaaaactgcggtccaccttaagcacgttagccggaagttccttgagatggctcagcgaggaatatccggtgccaaaatcatcaattgcaatcccatatcccatgccgcgcagttcctcaaactcctgattcaggaaatgcaggttcggcacccagcagctttccgtcagttccagaaccatctgccccacaggcaggtcaccccattgtccatccttcagatattccagcagcgcattgtcctttaactggatatatgagacattgacgctcatggaaaagtcttctttatacctgctccatatctggaactgccttgcactctcctccagcacccaggcccctacctgtgttatgaggcggctctcctccaacaaggggatgaactccgaaggcggaacctccccatgttccggggaatgccaccgcagcaatgcctccgcgccagtgaccgcccccgtcaccgcatccacctgtggctggtagaacagttcaaactggctgaacccatccttcacacaggcgtgcaggctctcctgcagctccatgttcctcagcttttgttgatacatttcctcggaaaagaaaaccagctggttctttccgttcatcttggcaatctcaactgcattttccgcattcctgaacagcttctggtaggtactggcatcatctgggaaaaagcaggcgcctgcggataaggaaatcagtatctgatggccttccaccgtaaaatggctgccgatgaacatctggatattctcataaatcccccgtacggtctcccttgtgccgtccttcaccagaaacacgaactcatccccatccagacggtaaagacggcatcccttgggaagcatggccgatatcagtgtggatagaaggttaagtgcccggtccccaaatgcataaccgtacttttcattgacattcttgaagtcatcaatgtccaggaccacgattacaccgttggcagctgtctccgttcccacaagggccttaatatcctgttcaaactggcttcggttcatcaggcccgtgacattatcaaatttattctgttttccgatattggaaatccggccaatcatgaacagcggccttcctgacccatctttctttacggttccccggcacgacacccatatgacccggccggatttattacagacccggtactccatgtcatggtagtccttaataccgtcctgaatcatctgcatatcattaagccacggctccagatcctccctgaccatgattcccgaccatgaagtgacaacatcctgttcaatcaggcggctgatatcaaggtcctcatatgcattatccgatatgtaaaacgtcccgttctgaatatcccacatataaagatagtcatccgtggtctcggaaagcaggttcaggaggacatccgcggtaaacttctcatcttttattatatcagccatgacaacctccagaataagtatggtttatattttaccatgaccggctttcagtgtccagaagcagcagatattattaaggattttctaatttttcttacagttggatccactatctttactttcatccatgaagtggttaagatacagcattataaggagggattcctatatgatgtactttaaacatttccattcatggctgacagcatatggaggcggccttgggaaactggccattgccagctggctgctgaccaataccatgttcctgctgtgtagccgtgtcccgttcatgaccctggattttgtgagacagatatcccttgggagctttctcggcatctggcttggtatctgcttctgcctcaccattccctggctgatatcgtcaggcaccggaaaaatacgtttatccctgacatccagtatggccatgtaccttgcagccctgatgatcaaggaaacattcatatgatgactgagcggatggacagatggctgacttcccggcggttatggatgatcctgggtggaacggcagtgctctggttcctgttcactgcctccatgaccatcctgcgctaccgcctcaattactcgtcagcttatgattttggaatattttcccagatgtattattacatggacaagggcctgacacctctgaccacctgtgagcgcgacgggcttctgtcccattttgcagtgcacctgtcccctatcttttatgtgctcctgcccttatataagctggtgccgcgtccggagacactgctggtccttcaggcgttcatggtcataagcggggtcattcccctgtgtctgctgaccagggctttgggccttacccgtcttaaaacgctgtgcttcggtctggtgtactgcgcctatccggcgttcatgggaggctgtttttatgatttccatgaaaataaattcctggcagtcatcatactctggaccatgtactttctggaaaccggacattataaatccatggcctgctctgctgccctgctgcttctggttaaggaggatgccccggtctatgcggcctgcatcggcctttatctctttctatataaaaagcagtatcggtacggattcctggtcttcgccggttcctgcctgtacttctgcatggccatctggtatatcaaccggtttggggacggcgccatggttaaccggtttgataatttcatatctgacaagcggctgggcctggtcagcatgttcaagacaatcctggtcaatccggcatatgtgctgtcgcagatagcggtaagggaaaaactcatcttcttccttcagatgctgctccccctgggattccttccgcttatgaccagggactggcggaaatggacccttatcatcccattcgtgctgattaacctgatgtccaattataaatatcagcattccattttctttcagtatacatatggttcaggcgccttgctgatgtatctggcggcagtgaactaccgtgacctgatggacatcccccagccggcatgtccaacgccagcatcttcccagtccctgcccaagccccgctcatccctgccatcctccatcctgtactgcggactggcctgcgccctgatgatcaccgccgttgtcgtgtacaaaaaaacgtattacatcggcagctacgcccaggaccgggaaaaagcagcagaagcaagactcctgctgtcaaccatcccagaggatgcatccgtcaaatcaaccaccttcttcattccccagctgtccggcagggatgaaatctatcttgcggacagcaggcatccggctgattatatcgtgttggaccaacggcctggatatgaaaaggattcccaggacctgatggctgattaccttttacagggatatgtggtccagggggaggtggacgggtatgtggccgtgctgggacctgccgtgccctcccactgaatccatattgactgtaaccacaatccgtgatatgatttgttcatcttttcagggcaactcatttgccccttatcaattcatatttgtatcacatgccggcagggtcgctggcggtttcacaggattggcaatggatacaggcagcggattcttgcattttacatgtatgcccggtataataatatcagataaaaatgtccccattccattgcattcagaacatattcaaacaggaaaggcaggaaaatgggacagagggatatctcgcaggtgcggtattttgaggacaaccagcgctatgctgatttaatcaacgggtttgtgatacgctgtaccaaggtaccataatgcgtagatagcgggacaaaggatagcgggtgccgtcatctacgcattatttcttccatgggaatgaagtcagatttccacatccagcacatcatccagatttatccttgtgttcaccacctgcagcatcctgctgttcctgtcaaaccgcgcaaccattcccgtcaccttcagatattcgcccttatggaaatacaccacgcttatgatcctgcctggtatgatttcccgcatcttctgattcagttcctctgccatgtcatcggacagcacaatcttaggcacaaccacccgttccttttccgccagggcctccggcaggccctttagcgccgcaaatggaaggaactgtttggccctgtcagccacagccatcttagcccttggtctactcgccacttttatgacctcctatctggcggttcctctccttcatggttgacgcatcctgcaggttcatgcccttaaggattgcattcttgccaaactttttcttgatatccagcatggccgtctgcagcttcctgttgcgttccagctcctctgcatcagcaaacaggctgtactgactgtattcctcttctaccacatgattgacggaaatgttaatccggtgtaccggcagtcttgggtttacaatccgctcatacagagcggtcacggccggtatcaaaaccatatccgcattggtctgcgcatccagggaggcggttcccctggacggctctgcttctgcgcgtttggaatatcccacatacagggtcacggaattggaaaccaggttcttttccaccatctcaagacacagcaggtccatcatctccttgacaatcagctccccatcctcaaagctgtaatcacagcccaggacctgcccacaggtaagacaattagtcttggctttataagacttgatatccccaatggtcacaggctccctgccccatgcatggtcaatcagaagttccgcatccacgccgaacagcttatataagaagtcctcatccatggccgccaggccgcccatggtatggatgccatagcgttccagcttaccggcaatgcccttgccgattctccagaaatccgtcaatggcttatggtcccacaatgttttcctatatatctcctcatccagataaccgatgcagtccgctgcatgcttggccgtgatatccagtgcaatctttgccagatacaggttggtcccgatgccgcaggttgcaggaataccgaactgcctcgtgatgtccgccatgatggactgccccaattccctggccgtgatatggtaaaggggcaggtaattggtcacatccatgaatgcctcatcaatggaatacacatggatatcctccttggagatatacttcaggtaaatgccgtaaatctccgcagcatactcaacatacagcttcatccgcggctctgccatgatatagtccacactctttggaatctcgaatacgcggcacctgttatggattccgagggctttcatggccggggatatggcaaggcagatggtcttttccgtgcgttcagggtcagccaccaccagtctggttgtcatggggtccagcccacgctccgcgcactccacagaagcataaaaagattttaaatcaatgacaagataggtgtgctgctccattccatccctcctctaccacggaaatatatccttattataattatacagcggcgccatgaaaactgcaatccatttatcgaacatctgttcttttgatatttcatatcatctcacaagtccatccaaaaaagcttccagcctttttgcaggaaccagcaggccatccttggagccgatgaaatgttttccggaccggtaactgggcactgcatccagacggttggtttcccaggcataccggttcccttccaccaattgtttcctgtaatgacctgcaccaaccatcttttggaaatccaccggatcaacccggcaccgggaagccatctgagaaaggatatccatggaggaaatatccatccccctgtcaaaaaccgcctcgtaagccagggcatggtacctccaaaggtccccctgatgctcctgtatataatacatgccctgtatggccttatcactgtgcaccggtgatggttccgggcggggatgggactcgcagggccgccataccagttcaatctgaggataacgtcccagaaggtttaaaagatttttatgcccacggtaacagtatgggcatgcataatcaaaaaacaactcaagttttaccatttccatcatttctcagactcccttcagcttccattcctttattcccatcgtcttccctgtcttccattaaatgcttcctgtaatacaagggcgtacaccccatataccggcagaatgtattggaaaaatggctgcttcccgaaaaccccacggccagcgcaatctccagcacgcttttgtcagaatgggccagcatatactcacccatccgcacccggtaggaaataagataatccacaggcgactgggaaaggacctccttaaaatcacggcagcactcactgacacttacattggctgcccgggcaatatcctccagccgcagcctgcctgcatactccttatgtatgtattccaggcagcagcggacacgctggtatctggaatcatggacggaaggacatggctcctgtttcatatcaagattctcaaacagtataagccctgcctgctgtaccaggatctgcagtttccacagatatcccctgggacggctgcaatcacactggtacatctcatggatacaggccagcacccctgcatgccagggacttgtcccgtccaggaagaagaaatctgtttccggccggaacagggcggatatgtattgttcctcaatcaacccgccggaaaggccatggagcagataactgtccgccaataccgcacagtagatacttccatgctggcgatggtaaggggacaccatatgaagcatattggaggggacaagaccgccctggccggaaccaatcacatacgtgctgacgccggtctggaattctatggttccttccaggacatagacaaattccagttccttatgccagtgccatggaataaaccggttgggatacaggtccagattgtcaaggtacacttccatgggaaatgccggagagccgtggcaggttatctcctccagattgccattcacttcaagataattcagctgcatggatatcctcctgtcccttcagggatctcttacataccttacatacttaatataaccggataccttgtttcctgcaaggccgtatatcatccttccaggaaaccgtatgtaacatccctgaatcacatattgacatgattctgttatttttagatactattataatagaatacgccatcatattctattataatataaaaaagagcagaattaccagaaaaattcagtaaagatgaaatgaccatgcgatgatgatttgaaaagtgagatgatgattttgaaagttgactacattacactccagaccctgtatccagataagatgaaggatttctatgtgaggtattttggggccgaagccaatgcagacaccgttggcactgacagttcagactcaatgtatatcctctccttccggggcggttttaagattaagctggccccggcaggacaaaccttatccgctccctcaccacagccggccccatcccagcttaatcctgtctgcctggccttcaggctgggaagcaggaaacgggtaaacaccctgaccagccagctgatactggaaggacacgagatactaagtgaaccccagctatcggctcccgcacattacagcagctgtatctttgacccggagggcaatatcgtggaactcatttcctaattgtcttcattatgagagatacgcaatcagctgccgccggccatgaatacgccgtgtggcagctgattctgattgtgttgaaaaagggtgttctttgcactaatcggatacatccggcggactttttaaggcagatggcagagtggatttcccaacacagcccggacatcattccgtcacaaccacataactggctgtcccaaagcatccattctcctccagatgttcctcatcccattcagccaccagttcatacaccctgctcactttaaactccggcatcagtgcgtcctcatagaccgcgctggacaacgggctggcgtccgtcccttccatatcctcaatggaatactcgtaaaccgtcagacggtcaggctgtattgtgaaggaaacagcgtaacttacagtattctgtccattataccggggaagcttcagggtttccttatcctttgcctcgaacagcggatgggcgccacaggcaactgcccctgtcatcccatccccgccgggataattccactgatagttgcctgatgtgacctcaaactcattcatggtgccggaaaggatatcggaaagcttcatggcaggcggttcctgccccacatttcccacttggacagaaggattcccgccgctttcagccttgcatcccgcagagcctgtaatgacagccagtacggctatggagacatacagtaccctgatatatttcccatatccttctttggaatatctgtctttggaatatccttctttggaatatctgtctttggaatatctgtctttgaagtgcctgtccttgtaacacctgtccttgaaattcctgcctttgaaattcctatccttgcaatatgccctcatatccccatcctttccgcaaaccgatatatacatgtcagccctgcagtttttcctgaccgcttaaaggtgtaattgtttcaatccacgctcggtatattgtcgaagtatgactgcatccttcgtagatgcgtggttgaccgcatggcagtggggataccgattactctccgcccaccactgccgttaagtttgtttttggcaattcatcccaccaccttagaggatgggagaatccttgctgatatttgttgaaaataaccttccgtcagctgcatactccggtattgcttcctggatttactatatcatattttttattttaataccttaacccttgcttaaggatctatggtttttctttaacgttttcctgtctccccttcaacgcctgccatccctgccatcccggttatccaggtaatactgcagtgcttcacccatgaaccgggaagcccctgtcccatagcgtttatccatgccctcaatcagcgtgggattatgaagatacccgtctatcagcacattccagtaattcttccccatgtccatatcgggactgtcctccttactcagaaggttcatcaactgattcacgacatcctgcacttccctggacgccacatccctggacacatcctttaacagttcctccgtcagttcctgattccgttccacatagcccttttccttgattttctccatcttctccatattttccgaaaaatgttccaggctgtgcttcatggcgtccacatacgcttcaacgcttccataatatttaattgcattctgtgcaatgcctgattcatggtccctgacccggtccaccagctcctcaaacttctccacgctgccccagtgccgtattacctcatccatgttctcacgtttaaaatgctccagcgcctccacatacccgcttaaatcaaattcctcaaagctcatgcaagtctctcctttttccagtttatccaacagttccagcagacggtccagtctgtcccgcttggccttcagcagttctttctgcttcctgaaggcttccagcctgtcatagtcaggatttcccataattatcctgatatccttcagcgtaaaatccaattcccggaaaaacaggacctgctgcaggatgttcagggatgcatcgtcatacagccggtatccggcatccgtgaccttggttggtttgaacacccctatctcatcataatattgtagcgtgcgcacactgacaccggtcagcgaggcgacttccttaacagtcctcatggtatcaactcctatctggtttatgatttacctttatcttatattatcacgtaacgtgagggtcaagggtttttatgataatttctgccaaaaggaatccttgccataccgcctccatcctgcccgcgccagataaagcgccagcaatacgccccaggaaaatgcctccgcataagcgatgatcatattcccgcagacagccgccatcccataagaagccagaatacgggatatcagagagacaatacccgcaatgctggaataaagtacgtccccaatcccttccagatatccgcgtacagctgttgcaagtccaaagaccacataaaagctggcaatcctgcgaaagaattcctgcccgattgccacagctcccgcacccacgccaaacagtgcaatgacatggccgcccgtggggatgaccaggattgtcaggcacagggatacaaccaccatcatgaccgtcccgacaccaaacaccttcctggcgcgcattttatcccctgccccatggttttgggccacaatggtggaaatccccgaccccagattaataaccggcagcaggatgattgtatctaccctgtatgcggtggtaatggccgccacggtctgcgttccaaagccattcatgaaattctgcaggagcaggcttccgaatgcgctgatgctggattggatcatgggcggaaggcccatgcgcagcccctgcaataatgcagtccggtccagcagcctgccagtcaggcgaaaccgcagcagcggatgcttaaccactgcatacagaagcaggaatgctgtcatggacgcctgggagacaacggttgcggctgcagctcctttaacgccccagcgcatgcaggccacgaacaggatgtccaggaccacattcacggcagaagaaaaaacaatggccagaaacggcgcccggctgtccccaatcccgcgaagtgcggctgagtaaacattgtacactgccagaaatggaatacctgcaaatatgatctgcagataatcccctgccaggcggattgtatccccggtcgtatgtaacaggcccagtatcggggatgccagccagattccggcggccgcaaagaatgaaaaacccacgccgaatatcagggaaaaggttgacaggatgcccggtatggccctggtttccccactgcctgatttatgggcaaagaggatggatagtcccagtgtgaatccggtaattgccataagataaaagttcacaaccgtcccggttgccccgattgccgccagggccagctcaccctccacattgcccacaataaatgcatccgcccagttatatagctgctgtaagataccgctgagaataagaggaagactgaatttaatcaggatgtatgcaatattttcctgtccgtcacgtgttttgtcatagcctttatcatagtcttcctcatgtccgctcctattcaccatacctatccccctcctccttccatacaaaaaaaccgtatgcagattcagccttgcatacggtaggtgctcacccggttcatatgatttgtttttggcaattcatctcaccaccttaggggatgggagaatccttgctaatatttgttaaacatttcatgccttcaatcatagcatatcacggatggaaatgcaaatccagctccgcccacggtgtccattggcttccccgcaagggtaaggacacctccagccagttacccaatataaccaatcaggtttttcgctttttcatactggctttcatcaataaaaatcttaaaattctgcctgtggtcatccataagacctgacgccgggcggccaaaagccaggagacttcctatcatccggcctgttccccccgctgatgtattttccgtgtcatatcttatattgtttttctccagtatggatctgatttttaaaaagtcatccagggaatcaccattatgccagggtatgtccgggactccggaatcccagcccatggatatttatgagcattttacagccaatatcctttgtatatcgtcataatgggcttcgcaggtaacgcggtagtgtatccagcctccgtcgccgcagggatatttatggtcaatgtactccctggcatatggcttcagctcttcatatatggattcaaactgtttatccgatagcctgaccatgaccgtaaacccgttgttttcggcgaatacattgcatatgagcttcttccctatcctgtgggcaattccccagccgtatcggttgccataggggaatgtaacctgctgcacggttttgtagttttcggacatccagctgttcaggcgggtaaaccgtccggcattgcagccgcagtatgatgtcatcatggtcatggttggtttttcctgcttattgagcatcctttcgtacatagggcctccttttttccgtccatccctgaatccggcggcgtcaggcgtccataaaccgggcgccgccattcccccaggatgattgatacatctgaattatctttatatagttgatttatctgcctttttgtgattacggagattgcagatttcccgtttttataaagtcaatgagcatttccacatcctcaaacccatcataatcaccgtttaacccttcgcggtgataaaccaccccagccttctcatttgcctccaggcagtctaaaagccgttcttcaccatacctttttacaaagaggttaaatgtatatggcttaatctttgacaatatacctttacggcagtcttcctcacagacatagcagtggctgattcccttttccaatgaacagttcctgtttttacaccaatccttgtcctggcattctcctgaatcacagcctgcgcagtgtgtattttccgaacataaacaacaggcaagcccgcatcttgcaattcccagtcttcttatcatcccgcacctcccctatcggtttttattaagtccagtttactacatttatgccatatcgtccacagtgccggcctccatataacccaaaccagccggataatcatttcatgccgggttcaaaatacacaaaaggaaatgccgtccctctgccaggacagcatttccccattcatccatatcttttacatatcctttatatatccctatattactgtgcttcctttacagccggaaggattacctccacctctgcatggggacgtgggattacatggacagataccagttccccaaccctctgggcagctgccgcgcctgcgtcggttgctgccttgacagcgcccacatcacctctgaccatcaccgtcaccaggccgccgcccacgaactccttgccaatcagcgtaacattggctgccttgaccattgcgtctgctgcctcgatggaacctaccagtccttttgtctcaatcattcctaatgcatcatacttcatttgattgtcctcctgacatttctgtttttattgttattttattgaactatctttaccctggatgaggagcttaagcccagggcattggcttcctccgtgtcaatgtggcattccaggccggactggccggttacgcgcacaatggtgttccttaagatgccgccccggattccatccacttccaggcttaccacctgtccgtcacggacacccatcctggccgcatcctccggaagcatgtggatatggcgctgcgccaccatcagcccctcttttatctgtaccgaccctttcggcccaatgatggtgattcccggggtaccatccaggtccccggacagcctggcagttgattttatccccagcttaaagctgtctcctgccaggatttccacctgtgtcctgctgcggaccgggccaaggatccggaccttttcaatggccccctttggcccgcagatggttactgtttccttgcaggcgtattgtccgggctgggataaatccttcatccttgacaattcatatccgggtccgaacagggcttccagatccccctgggacaggtgcacgtgacggttggaaacgcctaccgggattgtattatcccgggcatccggaatgcttttcctggctgcttccataagaagttttatgattgcctcatactggtccatgactctcccctttcctacgcatccttctggtccttcatggtggtgatcagctggcgcacaagggctgccagcttttcattttcacctggaacggccttggcagcttcagtggtatccgcggccctgtccgtattccttgcatcataggcagccacgattgccgccgggctgagattaccgcggcatggcccgcaggcagacgctgcctgggcagggatgctgccggccggctgatccgtcacagccattcccgggtgaaaggttttgtcatcttccatcagcgtggtacagtctttcagcccataggccaccttcttgatattaatcagctgcaaggggctgacattttccgaaacagagcttcccccgcaggttccgcagcccagggtaaatgcaacgttaaggcctgtgctgattcctgtgccgccctggctgcctccggtgttgacaaggatcctggatgccggcttggcagcgaatttaagtaccatttcccggtcctgggtatgcaggctcatggtgtggccgataccgttctggagaaggtcaatgctcagctggcaggcttccttccaatccttcaccgtatagaatcccagcacggtggtcagcttttcataagacagggggtatccctcgcccacgccttcctgctcaccgatcaggacccttgtgccttccgggattgtgatgcctgcgccctttgcaattgcctggggggagcggcccacgaacctggcgttcatggcatggccgttcttaaacagcaggccgcataccttttcggtctcttcctttgtcatgaaatacccgccctgggcctttaactccgccaccacctcatcatggttgcattcctcgcagattatggactgttcggaggcgcagatggtcccgttgtcaaaggtcttgctggccatgatggtcctcaccgcatggctgacatccgcggtcctctcgatgtaagcaggggaattgccggcccctaccccgatggcgggctttcccgcgctgtatgccgcttttaccatgcccggacctccggtggcaatgatgacggacacttccctgcaatgcatcagttcattggttgcacccatggtcggcatggaaatacatccaatcacatccgcgggcgcccctgcttccacggctgcctggcacatcagctgtgctgccttcagggtgcattttgctgcggaaggatggggtgagaatacaattgcattgcctgatttaatggcaatcatggacttgtatatggcggtggaggtggggttggtggatgggacaatacccatgatcagtccaaccggctccgcaacgtccatggtacccctgaccgtgtcctcgctgatgatcccaacggtcttcatgtccttgatatcctggtagagaagggtggatgcggcgtggttcttgtaggttttatcaagctccttgccgaatcctgtctcctccaccgccatccgggccagacatgccgcgtgctcctctgcggtcctgaccatgttctgtaaaatcctgtctatctgctcactggtatatccagccatcttctttgctgccgcttcccccctgcgggccaggtccctggcttcctgtatggagcgcaggtcgtaatcgaaattttccatgtgaaaattacctctctttgctatttaactgctttatatgattgaagttccctatcacaggtccgcccagttggccggatacgtggcgtagaatatcctggccttatccggcgacccccagatgacctttgaaccggatgggacaaacaggacatcgccttcatgggcagtgtatgtggtcccgtcaatggtcacgttcagcgtgccctcgatgacataatcaatttcctcgtaggtcagttcccattcaaaatccgagtggtcaatcacaaggaaacctgcgctgatatgggattcctccttgcttataagctcctgatagtacgctgtggccttgggattcccagtgtcgaacacatccattttcaccgaatcccccctcaccaccttaagaccgtttggatggctctgcgcatcatagggttttaaaaacccgtccagcagcctcttatccagaagccccttatccaacagggctttcagcaccatgtaaatctgattggcatccatgtcctggccgcccgaaggtgcattgtcatcgccgcattcctttttatatgtaaatgtcaccccaagggagtcagccgcatcccttgccgaaggggtgacaatggcgtcctggtcaatgcacagttctgtcttcccttcccccttcagggtttccacgtcttttgcgcaaaccagctgtttcataccctcacttcctctctgctcttctcattgctcttcccactgcctttcccactgcccttcccactgctcttcccactgccctttccactgcttttcccactgcccttcccactgcttttcccacggtctgccttcctgcctgtcacttaaaccgtctcctgaccgaaggtgcagtcctcgtctatgatcccaaccacaaccgcgtctaccggaatcccgtcatccttaagcatccggcgggcggaggaaccagtggtaatgatgacccggtcaccgatgcccgcgctgatggtatcaaccaccaccatctgttcccctgccctggcgccgccgattatctgagccagcatcagcttacagccatttaatgtctctgccttcctggtggcccatatgttgtcaatgagtcttgcggttaccatccttcccctgcctccgtttcctttttccggattgcatccatcgccgcctccaccgaggccgtatcgccgaaaatggccagcagtatcatgttctggggacagctgccacgtatatcttccaccgtgacccccactgccttttccgccacatcggcggcgcataccatttcaatcatccggccctgtatgaggccgatggcgtccgcctgccctatgggctttgacggccctgaccctttcctgcggcacagtatgtcgatggtgccctgggtgggcgatttaatgattcggtattccatagacaccttcatcctttcttatatctttcttaccatgcctgcggcatgttaccttcccgtccccttaccaggctgcccggcagttcattgcgattccaagaggcgtcacaaacatggggttgcccggcttataggtaggaatcccggttttcttttcaatgattccttcaatccctgtcagacagcaggtgccccctaccaggtaaatcccatccacttccctgccctcaatgtggcggctgataatggatgaaaccttttcaatcaccggctttagcaccggtaacagctccttgtggttctttttatcccgtttgtagcattccgcatcagcaaaggacatcttataggcgccggatatcaccagggaaaaatgggtccctccggtaggttcatccgccacatagaccacctttccatccttcagtacagagattcccgtggtgcctcctccgatgtcaaccacagccccattgcgtatctttaaaaccgcattggccgcagtaggctcatcgggcagggccgtgatttcaaatccggctccctgcaccacatttttaatggccccggagtccagggcgtccgtgcccggcggaatggcggccgccgcataaaacagtccggtccccagcttttcctccagctcctccttcatttccctgacaatgcggatggcgccgatgtaatccaccaccatgccgtcccgcaccacatccgcatagcggaaggttccggccaccgggcgcaggtgttcatccaggacagccagcaccacgcaggcggtcccaaggtcaacgccggtatagtaaactgccgacggttcccggacaggttttgccatcacggcttcaaactccctgaccatacggtcgcaggccttaaatgttaattcttcttttgacacgtctttcctccaaatgcctggcagattatctgtgacagccggttgatgatacggttaacggttcccttcttatcttcaggaagtgtgcatgacaggatacgcagctcacacctcaggcagtgaaggagggcaatctcacgtcctctgggggattggacatggaatccggtgacttcaaagcagtcttctagctggctgtccctgttttcctgtgtgattcctgtacagctggcccatggcggccctgaatccggcatttcctgtgtgattccggccagactccgctccagctcgaatatttcccgggccgccagcacatccatatccagcaggctggccccggcctccaggaacctggcccggacagagcggataatggcctcttccagcggatatgaggcaccgtggattggggatgccttatcctgtgcctgatgtgttgttccatccatgggttcggctgtctccacggaatccttgattttgacaccgcggtcatttaaaaactgccttccccctggtgtcagccgctctcctgcttttgtctcataggatgggaacgggtgcttcttatagacagcacgcaggtcatcctctgttatgaacctcatcccaggccccctttgcacagccttccatatatatcttccagatcttttaaagcaggctttcttgggttggcagccgtacagccgtcctccagggcttttgcggccatgcttttaaccgactgcaaaaactcttccctgtcaataccaagctccgtaacctgctccggtatcccaatgcgcttcataaggttgcggatctgccggatcagtccgtggaccgtggctttcccggttccggctgagatgcctaacagattggcaatctccacataacgggaaagcgcttctgtctcaccggcttcctccaggcctgcattatatgtaatcacatgcggcaacaggatggcattgcttctgccatgaggaatatggaagcgggcccccagggcgtgcgccaggctgtggcagattcccagggaagcgccgttaaatgcaacgccggccaggcaggatgcattgtgcatatgggtccttgcgtccatattgcttccgtcggcaaccgcctgctccagatacttccataccatacggaccgccttctcagcacaggcatccgtaaaatcccctgactgagtggaaacataggcttccagcccatgggtcagcacatccatccccgtgtccgctgtaatcccggaaggcaccgtggctgtcagtaccgggtctaaaaaagccacatccggcaccatgacagggtcttttagcgggtacttggcctgggcctctgggtctgagatgactgcaaaggatgtcacctcacttccggtcccgcttgtggtgggcactgccacaaggcggggcctctgttcctgtttcattgccgcataaaggtggcagaccgccttggccgtgtccatggcggaaccgcctcccagtgcaatcacggtatccggggcaaagtcttccatcccttcaattccctgtgtcaccgcctcaatggtggggtccggcacaaccttggcaaatatccggctctgcgcccctgtttcctctagaagtccttctatctctgaagcctttcctgatttctccataaacgggtcgcatataatataggccctcctgattcccaggctgtttaactgtaaaaggcaggcttctcccatatatatctttgttttcatgataaactgttccatgtcctgtccctcctttctgtcattttttatttcaaccacattttattcccatcccattccggcgttctgcagcaggccctgatttcacggcacagggctttaagcccatctccgtcctttgcactggtcatcagatatggtttctttatccctgcccttgcaagctgccaaaagcagggctcaggccctctgcgtcccgcctgtatcaggtcacattttgtcacaatcccaagcaccggcacacggaatgccatggcaaatcccggcgggtaaatctccctgttccccataagatccaccagcatcaggacacaggatgcatcctgggccgctgctatcagatggtggcgcatccatggactttccagataagcgcccggcgcttcaattatagttcccctgtacacaaggacaggagtccggcgggaccaggggtctattgctgtccccggcctggtttggctgcccgcagttgtctccagcccgttttccccgcccaccgtctccttccggtttttgctgtccgccgtggttcccgcctgttccagccacctttccgcctgttccagctgccttcccgcctgttccagccgccttcccagcaggcttttcccgctgcgtcctgccccgattatcatgatccgttttcttctcacgtccttgtaatctccgccacagtgaatcccagcagccgcttcagcgtgtcgttcaccgccttcagggcagtccccacgctctccacatccccggcaatcacaaccgaaccagtgaagcggtccaggaatccaatctgcacatccgatgccttggccgcaatgtccgccgcaatgacagccgtctcaaagggactcagcgtaagaatcccaatggcccccatgtcatcgatgccaaggcattcatagacctccggcaccggggatgctatcacatgggcaatggttacctgcttacccggcacggattcctcaattacccgtctgacctctttaccttctgtcaggcacatgcttaaaactcctctctctggcgtttgtccatatggtcttcccttattaatgcctcaccacgttcacagggaaatcataggcttttatccatccttcaatccggtccaggtcctcactgctaaggctcggatcgccctcaatgggatagggcttatccagctggttgtatttatttacacccatcttatggtacggcagcaggtcaatccctttgaagttcctgttttcacggtagggaagaaggaattttatgatctggtcaatctcctccctgctgtcattgattccctttaacatgggcatacggaccttaacattgattctgcgacgcaggagttcatttaagttatggaggataagctcattgctgatcccggtcagttcattgtgccggaccgggtccatgtgtttcatgtcatacaggaacaggtccacatactcagctatctgaagcagcttttccgttttcagatgcccgcaggtttcaatggcagtgttgatgccctcctccttgcacgccatcagaaggcttttggctgcttccggctgggaggtgcactctccgccccccagggtcacaccgcccccggatgtctcataaaaggcagcgtcctcttccaccagcttcagcagctcagagatggttttcatctccccggttatctcgatggctgactgggggcagctggccttgcatttgcggcagcctgtacagtcaatgtcgcgccgtatcatatgctttcctgtttcttttgacaatacatggattcccaccgggcaggcatttacgcatgcgccgcagtccgtacaggagtttttcttaaacatgacctgtatcctgcgctccatcccttccgggttggagcaccacctgcagcgcaggggacagcctttaaagaaaacaatggtgcggattccgggtccgtcatacatgttgtatttctgcacattgaaaatcagcgccttcctctcgattccggccgtatttgcatgttccattcttccatctccattcattcctgcctgcttctataactgggtcagcatggtcctgcttatgatttcatcctgcacatccctgcacagttccacgaaaaaggcgctgtaaccagccacgcgcacaatcaggtcacggtactgttccggatgcttctgcgcctcaatcagcgtgttgttgtccaggtagttaaactgcatctcgccgttgcccagcatgcaggccgtgcgcagcagcgtaatcaggctctcctcgccctggggcgtatccagaagccctgccatgattttaaagttatgtaccattccgatgttcatactgtcattggacatcttggacacggacttgatgatggcggtcggccccttgtagtcagcgccctgggtcgggctgatcccatcgctgagcggcagccacgcatggcggccattggcagaagcccctgtcatctgtccaaagggcgtattattggaaatggacagggtcccgtggctcaggaccgaatacagggtcttgtatttcctgtgttcccgctccgtgaaattcacaaggtcggcggcaatcagatccgcgtaatcgtcatcatttccgtacttcggcgcatttaagcagtcggtacggatctgcccataccccttaaagtccgctttcagggcttcatttatctgctccagggtgtatttcctatcatcaaataccagtttctttatggctgccatggaatccgtataagtagccagcccggaccagacaacgcccggtccaaagttatacatggcgcctcctgcggaaacatcctttgccttctccatacagccctcgtacatgatggacatcaggggctttggcgccaggtcgcggtggacgcgctgtgaaatcaccgtggccacatcggtccactttgtaatgaacctgatttcctcctttaccgctgcctcgaattcctcatatgtccggaaccggctcaggtcccccatgtccgggcacacctgcttgccgtaccacagagggactccgtggtttaacaccagctcgatgcagataggccactgggtataggcggtggaggtccactggtacagacggccggatttctgcggttccacgcatcccataaggcagtaatcccttgcgtcctcaatggacacgccctttgccagcatcatctttatgtgcgcgtcatcaaaatggcaggctggaaagcccatgccggagcgcaccacatccacgattttcttcagatactttttcggcgacttgttgtggatgcggcaggccagggacggctggtaaatcttcacatggcgcacggcatccatcaaaaggtaggtcagttcattggtggcatcgcgtccctccctggtcacgccgcccacacacatgttcacgaatggctggtagcccgcaaagaacttggaaccgccttcgcttgtaatccacatcatctcggacatcttgatcagcatgcatcctgccagttcgaatgcctggaagtcattcatacgtccgctttcaatgtccgccttatagaagggatacatgtactggtccacacggccgatggacatgccggtctggttctcttccaccaccagaagggattcaatggtccacacagcctggatggcctcccagaatgtctctggtttatgggccggcacccgcgcattgacctcggaaatcctgagaagctctgccttgcgtttgggactggtttccttttcagccagttcctttgcatatcctgacatcctcctggcgtaaatcatcacgccttccgtggtatcgatgatggatttgtagaaataaatcttctcaatatcatccgggttctcataatccagctgctccagatggtccatggcttccttctggatgtccagcattccttttttcatcagaatcacatcgtacccaggattggaatcaccgcccccgttcagtgcatggtaggaacagtcagacacaaaggattcgccggacagttcccagacccctgcctcgcggtactggtcctcgcagtactcatccacggatttgcccttccagaacgggaacagctcctccctcatgattttcttatcttcttcggaaatatagaatgggtcctgaggtcttgttccgatggtgtcaatctcatcctccatccatctccatgcaatatccggtgaaaatgcacctgccctgggtgcgccgcagggagcgccaacaatcagctcattgtcctggatgaccaatggcgctgtctcacagcagtagcggaagcatttggcccgcagcatgatttttggcattccaggattctccctggcaatcttggtgatggcccgcgcacggtgcgtggttatggtcggcttatgggtcagatagttctccttcagggcctggagacgggcggtgatgccgtccggtatggaggttccctgtgcggccccgctttcctgtacggatccggttccctgcacagccctgctttcctgcacggatccaccgcactgcacagccttgctttcctgcacggatccaccgcactgcacagccccatttccctggccgctcccaactttcgtaatctcatcggccacggtttcgaacattttcatcagtgaggctttctcttccggagacatgccctttgcggcttccgccaatttatttgaaaattcacgaatatccaatatattcccctcgctttcagcttatttattttccttatgggaattgtttcagcatattatcagcactttatgctatcggctgctatattcaatcctcaagctgccgcagcactgccctcagcagtcctgccacatccaacgtatcctctttccggttttcatccctgactgctgctgcattttggtccgcaggcatatccgcaccggccctcacatcctgcccccggcctgtaccgccatcgtcaaaggcttccggtcccggtatctcccttacgccccaggcagcatttctcatatacaccaggttcatgggcgatacgttgtcgctggtaatgcccagtcctgcggtcaggccgccaagggtcatggacgggaacaggtccgtggtgacgcccatggcgccaaagacagccggggtattgaccaggatccttcccactggtttcttaagcatgaactgccggatcacatcctcgttttctgaatggattaccagcgtgtgtccgcagctttcattgaccagcagctccatgcacttttcacaggcatacatccagtcatcttcaatatagaataccagtaccgggcataacagcgcgccggaatacggattaaaatcagttatgtacgtttgctgggataccagcacctttgtatcttccgggactgggaatccggctttttgggccagccagacagccgtctttcccatgtattccgtctccctgccgccttttggccccagcaggccgatcaggcgcgcttcctcctcctcattcatgaagtatgcgccctggctgagcatttcccttttggcttctgctgcagcctgccggtcagcgaccacatactgctccgctgccgccagggttccgcagtcaaaggaacggcttgctataatgtatcccacggcccgtttcacatccgcggtccgttcaatgaatacagggcttgggccgattcccccgcagattaacggtttcccgctttcccggcaagccttaaggagtccggggaccccggtattaatcacaagtgaggtcaggggatggcccatgagggcagcagtcccttccttgcccaccgtacccagacatgagactgcgccctggggcaggcccgctgcttctgctgccattgccagcagcttcacggttttctgcaccgtccgtcccgcccttggatggggagcgaatactaccgcattgccggatttaacgctgattgctgccaggaacaaggtggtggacaccgggcttgtggccggaaccagggccgcgatgattcccaggggcacgccgattttggcggtcttactgccgggattttcttccaccaagcctacgcagcgcattcctttaaggctctgtgacatctggttccacaccagacagttcttcctgtatttatcctgccagttcccgtatcctgtttcctctgctgattccacggccagttccttaagacagcctttgatggcttccagcatggcccaaaggcagcggtccagcttttcctgggtgtacagggccagggccttctttgcttctcctgcatgttccatcaggattctggcttcctggacagaaagcaggtccttgtcaataaatttcatatcaatgcctccattccattacccctgaggcagaagaccctccagtgagtagcggatcatgatcttctccagatggggatgaggccttgggatcacaacggagctgtaaaccccggctcccatggcatccactgcctttatccctgcctcaacagcggtcctgcaggctcctacatccccctgcaccaggacggatatgtatcccgaggccacgttctcatagccgatcagctccacatccgccgcctttagcatggcatccgctgcttccagaacaaataccaggccaaatgtctctatcagtccaatggcttcatatctttccatatgtttgattcctccctgctagtacagcattgcgtaaataacggtgaagtcagtgcctgatatctgcgtcaggagtgcgtctgtaaagcgacggcgtagtgggcgctacgactagctttgcaggcgtgctcctggcgtagatagcgggtgctggattcactggtatttatgcaaggctgtactagttattatgggcgccctgccggattggacggctgcgccgtttcaggtatgcctgcacggacatccgcgccggttcaggcgtctatatcatgaaccgacacaatatcccccaccccgcggatgggccttggcattacatttttgaccgtcagcttcccgatggcagctgccgctgccgcgcctgcttcaacagaggaacggaccgccgccacatccccttttaccatgatggtaacaagggtggagcctacattttcataggaaaccagttccacatccgctgccttgagcatcttgtcggctgcttccagggcgggaaccagacccactgtctccaccagcccaagggcctcctcgccataatatctcatatacggtacctcctatcagccgcacatacggtatttttccggtacatatttctcaaccgttgatttcccgtctccgttgatggcatagcgcagggaaagttcccctgcttcgtccagtttgtagctcttaaggtccaacagcccattggcttccaaggacatcacatggtccaggaaacgcgcttttgtaaactggcgctcattgccgtaccgtggctttaatgcctccatgatttcctttatgtccgcgctttccacgccgtataaataatttaacaccgctgtccttgccggtaataacattttcctattctcccttcttaagcagatccaatgggttcatggtcacaaggattgccccggatacgattacgatggaaccgatcacaatggtggctgtaagctgctgtcccaggaacatgacacagaacagtacgccccagaaagcataggttacattcagggacatgccgatggcgcagcccaccgtggaattgctcttataccagcatacaaaagacacggccgcgcttaaaccggaaagggccagccagataaggggaagccccgctgcaaaggttccgcccagaagcgccatacctccaaccagggggacaatcaccgccaggtccacgatgccggatatcagttccctcaggttcaccgccacatccgtgtcaatcatggctccgccgtagctggaaagcattccttccagtccccagctgactgctgcaatcagggcgcagataatgcccaatgtgaaattggggctgccctcaggcttaacccagttgattatgatggcgcccgccacacagattaccattcctgccaccacgcgcctggtaggcttctgctttaagaaaatccatgcaaaaaccgctccgaacaggctgcaggtggcggatatggggatggcgtaggcgcctgccatggccaggcccaccagataggctccattggcaatgggtccgccaaggagggaacccagcacgatcatcttgccgggaaatgtatgtaaactccgcaaaagctcactgagccttccgcatcttgcattgtatatggtcagccagatacctgcgaacaggtcattcagccctgagcagacatagggggccgccagcaccccggccgcgcttagaagaggctcgtaatatcccgccaccagcaccagggtagtgtaaatcccataggtcaggccggataacaggccggttgttattcctgtcactcggaatttcctgtttacctgtttcattttgtcatcagctgtcatggggactgctgccccgtaatttactgctgcaccttctccgttcatagatggaatctccttttagtcactattctgctgttctggttgttcccggaagtatggtttccacctcgctgtggggacgcgggatcacatggacgcttaccagctcccctacccttcctgcggcagccgcccctgcgtccgtggcagccttgacagcgcccacatcgcctctgaccatgactgtcaccaggccgcctccaatcatttccttgccaagcagcgtgacatttgcagcctttaccattgcgtcggctgcctcaatggaacctaccagcccttttgtctcaatcattcccaatgcatcatatttcattgttcattactccttttctttcacctgactgcacagtgtcaatatgcacaaaagcaggatgtgtgattttgttttaatggttttgtgtctggccttcacaaattagaaaacattctgaatcagcaatattactaacttttaaaatgcactccatgtttttctatgcatttagtatagaccatgccctatggtggaatgtcaaccgtttttttgagattttcttaaccagcaggaaaaataaaggatgaatgtaaatggacaattctggaaacccttgcaatatatggattttcgggcggtgatatccggaatccaggacaaaaaagaagcaggtaccaaggtacctgcagaccaaaaacgacagttttatgctccatccatttacaggatggaaaggaaaacgacatttcccctctttatgtccattacaaatctttcccctaaggggaagcttttgaagggcttagggcccgtccatgaccggcactatcacctcggtcacaaattcctccgggttcctggttgtccagtagtccaccacataccgctcataagactcagggccgcacttatatcccctgtcccttgcccagtcccgtatcttcttataagattccccaatccgttccaatgcacccagatgataaaccgtcaccgccatgatcccgccgaacacggtcttgttggtgccagccatacagggccggacgggcctctgcatgatcctggcccgggtgctggtcccttccatcttatccgtccaggaggggaaccttaagattacctcccctgcaatctcattgttcacgctttccagataattcacccagtcaatattgatgatggattccatgtagcggtaggaaaaatcctggtccatataacagtagtcagccgtgtttatgtatttaatccctgcttcctgcacattgctcctggacaccagctgcgcctcctggatcagctcataccagtcctttacagccatatagctgttgtggatttcctgctcctggatcctcagttcatcaatcttgctgatgaagttctgtttcacgaaataataggtgttcccctccaccaggtcctgcatttcctccagcttaaaccccatctgcttgtaatacttaacgataggcaccgtcagcagtgtttccctgttataataccggtaaccgttctccttacagatcacatccggcgtgatgattccgatctggtcataaaaacgaagcgccttttttgaaatgttgcatatcctgctcacttccccaattgaatataacttttccttctgcatgatccccgatgttaccccctgtcagtttttaggaaccagccttcccggctgttcctgtcattcaaacatgtctatacacataagtataaaccttcccgttatgtggaatgtcaataaccattcgcggcgctcaaaatccctaaaatcagcgcaaaaatgaacacccggcgccgcgctgtgtcagccaggccgcaataccgggccagtaaacagggcaatcctcccctgcttttccatccgctcctgtcttggtccatttcccccttcccctatagtggaaggtttttcatccgggcggcggggtaaccattacaatgatttccgttacaaattcttttgggctgcgggtggtccagtaatcaaccacataccgctcgcagcacccttgggcacaggtatagcccttaagccctgcccatccaaggatccgctcataggcctgtccaatgctgtcataatcccccacatggtaagtacaggcagccatctgtccgccgtacaggatctgggatggatcctcctggtccggccagaccgcctgctgcatgatccttgccctggtacagttcccggccatcttatctgccatggacgggaactggaggatgaccggtcccgtaatccgctgcccggcctgttccagataattcgtccagctgatgttaatgacagactccatatactgatagtcaaactcctggtccatataacagcaggaaaccggggttatgtagcgcagggacacatcccggatattgtggcggattaccagttccgcctccttcaccagttcataccagtccctgacagccacataactgccctggatttcccgctccatgtccttaagttcactgatcttactgtggaaattctgctgcaggaactgatacgtgttcccgcccagcagttcctgcatttcctccagcttaaaccccatctgcttatagtatttcaccaccggtaccagcagcagggtcttcttgctgtaatagcggtagccattctcctcgctgatatggtccggggaaatgatcccgattttatcataatagcgcagggcttttgtggatatgccgcagatgcggcccacctcccctatggtatacagttccttatccttcaagataataccgttcctttccctgggttttcttcctgtactccaccgctgtcaccgggcagccgcagatgcaggccatgcactgggtgcattcgctgccccagaccggctgtttcccctccatcctgatattgttaagggggcagagggatgcacatttcccgcagccgatgcaggcagatgtggtgtgatacccctttgctgtcacgaacaggggatagaacaggtcattgacaataccgcttttaagggcattggccacggtcggtccctgctccgggaacttcctgcccccgcccaccagggaggcggcaaggaggatcggctcctttgccctgcggatgatttcctgtatctcttccctgccaggcgcctggtacatggtgatatagttctccggcatccggattcccataagcccctgatatgccagccccttccgtacacacagcttttttgcatacttcccggccattcccacgtccccgccgcaggtcagcacaaaatagatatccgcattcccctcaaaggccgtttccaggataaaccgttccaccacccttggaagccgccacgcataaaccgggctgaccaccacaaagggcgtcttggacaccagcgcctcacggttccctgtcttaagacggtcattgatggacacggcctcatccttcagttcctctcccatcatctttgccacataccggctgttgcctgttccgctgaaatacagtatcatatttttcatctcctgttattatttatacgctgcagtgtctgccaaagcttccgtatcagctgttttcccacactggttgacgccctggacctacaggatccgttttatcaagattatacaggaacaacggaattattgcaaacttgacagcgcatgggatttcatgctatactggcgttacaaaaatttcagtgtggatttttctagttttgactcttttcgccacacaattgtcttataggcaattgtgtggcttttttgtttctcatatctggaaacggaactgctgaacggaatatggaggttgtaatatgatgaacgatgattttatgaaggaaaagcccattctgccgctgcttacatccatggcattccccatggtcatttccatgcttgtgggttccctgtataatattgttgacagctttttcgttgcacagatcagcgaaaaggctatgactgcattgtcccttgtttttccggtgcagaatttcattaacgctgtttcaatcggatacggcattggtatcaatgcattgattgcattcagcctgggggccgggaataaaagcaaagccagcctcacagccacccaagggctgttattctcagtcatacatggaatccttgcaatggctgtgtgcattcccatcatgcctgcattcctgcggctcttcacatcggatgggacggtcatagcactgggggtacgttattcttccattgcattcctgttttcaccaatcatcatggcagggctttcctttgaaaagattttccagtccgtgggcaggatgaagattgccatggcaagcatgctgtgcggatgtatttccaatatcatcttagatccgctgctgattttcgggattggttttttcccggaaatggggattacaggcgctgccattgccaccggaatcgggcaggtcatcacattaggaatctacctgatcatgtacgtggcacaccctattcccgtgcatttcagccgcaggtatctggcttttaacaaatccgtggatgtccggctttatgccatcgggatacccgccatgttaaacctggcccttccctcccttttaatatcattcctcaatgccatcctggccatgtattcgcaaagctatgttgtcattttagggatttattataaattacagacgttcctttatcttcctgccaatgggattgtccagggaatgcgcccccttataggctacaattttggcgcgggggaacacggaagggttaagaaaatatacggtatgaccctatgtatgagcggtatcataatgcttcttgggaccgtggcatgcctgacgtgggccagacagctgattggactgttcacggataacccggaaacaatcctggcaggacagacagccctgcgcatcatcagcgccgggtttattgtatccgctgtctcagtcacatcctcgggagcattggagggacttgggaaaggaacccagtccctcataatctcactgttccggtatctgttcatcatcatcccggcagcctccctcttatgcagaatcatgggacctgtgggggtctggaatgcgttctggataacggagttcatgacggccgtcatagcagccattgtctaccacaggtcagtgaatatggcgggtggtgtccgtgaccatgcctgcctccgcaagaaggagtcctgctgacggcggaatcccttggcggatccttatggcggattcttatggcggattctcatggtgaatccttatggcagatccttatggcagattctcatagcggattccgttcaggatgcagtcacacacctgccgccgatatggcctgtaccgcttcctccctggaaagccactggccccatgtataccctcccctggccctggatgtatcatagaccgcattcagggccttgtcatattcctccttcgtcatcacgacgccgttccattgatactggtataccgggttctggttctcatcatactgcacctttgagttatcccctgccccataatatccggctgcggcctgtaccaggcgtccgtcttccagccggtatacaatgtcatagtagctgtccatattgccgtccgaattacacaacaggttttccctttcaatataagaaaagccaagcctgtccagccgggattcccggacctgtccctgtgcgtagccggcaatgctgcagccgaccgcctcgctgttaccaatcatcaccagctccggtatatcgtcattgtcaatatagatcagattgtacccctgccactgttccccatccagctccatgatatagtcgatgtatgcctgtttccattcagaacccgcgctgacggcatcccctcttcccacgcctaaaaatcccaggattgacttcaccgtcttatccgcaaccgctgagtttgccacatccgaaagatccttctcaaggacaaaggaaccgtccgcgctgccacggtaaatccttgcctccgagtatcccgtccccgcctcagggccggatgccggggaataactgcagatgatgatgatatcactgtaaccatcgctgttatagtctggaaatgatacggcttccacctgattgaaggtctcattggcgcggacattgtccccgtatacgccctccagggtatccacagcccgcccgtccttctccagcctgaacaccacatcccccataggatttttagctggatcaggtccgtaggaagcaaaggtcacatcgcccagcggaatcaggctgacctggaatgtctggtcctttatcagcctggcctgtatcccgccgtcctgttcctgggcgccgcccgccccactttcctgtacctcattgttccccgtcccgtcctgcagaccgctgttccctatcccgtcctgcagattgctgttaccagtcccattcagcgtcccgctgttttcctccccgttccccggcttcccgtctatccagatttcactgttttcttctgtctgcccggtacgggattcctctgtttcctttgccttgccgtcagggccgcaggcggtcaatgccgcgcaaagggccatcaggcacagggctgccgtgcattttcttacactgattttcatgattttttcctcccaatgtccgttattgtaggtcatttctctgtaaagcattgctatatcggggatttccccacatgaaaagagccgggagcttcctgttcccagccgcttatcattacgattccagcctggcatatccggcgcaggaggattccctcccttccaaggccgcctgtctggctatcctgctaatgaggcgctcagccatggccgccgatgtcagtgtcacatatatctccagcgcgctgctgatgatcccggctgctgccagaagaagcgcggacccgcccacaatggccagccagccataaaggaacccccggtagacctggggatatatctggtactgggaccatatgaccaaaagcaggtataaaagcaccagtactgcggataaaaatgcaaatatgatatgtaacactgatttcagcggaagctccccgggaagataaggcgtcgtgatggcgcagaacaacagcaccagggcagacgggaccatcctcccgcaggcaggatgcaggggcagacgggatttaagtttcctgtggactatatggaaaaaaccgcccaccagcacgccccataggaaaaaagaccgctttttatcaaagaagttgccaataacagaaaaattggtggtaaaccaattgtatcctcttgtaaataagaccgtatatacgggaattaaaaagtaagcccagaatttcatcaattgaccagtccgtttcttttgttttatacagtatagcagacagttggaaatttatatttaagaaaaaatgatttctttctgaacaattgataaaatattcttacgtcctccctcccctattccatccttctaagtaccgtgcgctcaaattcatccaccggcatcggttttgcaaaataatatccctgtcctatgtcgcagctgaccgattgcaggaattccagctggacttcattttcaatcccttccgcaaccgttgtgatggaaagcgccttggcaagatggatgatgctttcaatcaccacctgtccccgcgaggaggtggactgttccgacaggaactccttatccagcttaagctccgcaatatccaggtccttcagggtgttcagggaggaatagccgctgccgaaatcatccatggatatggaaaatcccatgtcatggagtttactgattaccatcttgacctgggccagattgctcatggccacgctttccgtcacctcaaggatgatcatgtccgggtcaatgctgtaccggtccacaatctggcggaacttgtcaaggtactcctcgtcatagaaaaatatcctggactggttcacggatatgggccgcaccttgtatccctgtttcatccaatgggaaacccggcggcaggcctcctccagcatatacatgtccagttcagtgatgaatccgttttcctcgaatatggggatgaactcatccggataatgtatgatttccccatttgagcaccagcggacaagggcttccgcactgtgaagggaaccatcctccagataatacttcggctggagatacatgtggaattccccgttggccagcgcggcctgcatctggctggcaatctcaatcttcctgcgcgccttttcatgcattgccccgtcataaaatgcaatggggttggtggtattgccattgacgctgttaagggccagcagggcgccgttaatcacggtatccggcgatgcagggtcctgtctgtccggatccggcgcctggatgatataaaccccgaaattacagttaatgcggtagtcctgattgggacttatggtatattcattgatgcccttctgtatttttttaatcctgtccgtcagttcttccctgccctggtaataaaccagcatcccgaaacggtcggcattatccctgtaatagcgttccccctccctgatatcagcgcgtaagaccttcgcaatatgcagcaggaagagattacctttctcaaagccgaaaaattcattcacaaacttaaaaccgcttatgttcatcagcacgatggcccggtccgctgtctcctttaacaggacaggcagctccgatacaaaccggttcctgttatcagcccctgtcaggctgtccttatatgcaaagagcctgagggattcatgctccctttttaataaggtatagatatacaggaacaggactgcgaacaaaaggaagatacaggccatcacaccggcaaacacaatgaatacgctgtcaaaattgtgattcaggaacgtctgcggcaccagacagaaaatctgccatccattaacccccaccggaataaaggttacccagtaggctttcccctgataatggaagacagcaaacgaatcaccgcccgttccaatgtcggccaatatggaggaacggacctcatccgtgaaatccccgtcatcaaaaatgttgcccatctgtttatttatgaccgcatggccggaacgcaggacgaaattccccttctggtcaatgatatgtacataggcaatgccgtcaaaaatctcctggctgatgatatctgagaggttggatgtggtccgggtagccgtaaccgcgccaatgacattccccttatgggtaaccgggaccccgtaacagacaaccgtgttatccgacatcttgtctttcatgatcccggagacaacggactcgcctgataaggtcctggcaatgaagtcttcatcgctggtatccaccccatagtgccttgttccgtccgtatctataaaatatcccttgcagtcaggaaaaacaaatcccatacggataaagtcactgcgggtgccctcttcctccagataagccagtaccacatccagattcacggaaccatgctgtcctgtaatggcagccactgcgtccaaggtctggatatccccgtcaatctgctccgtaatgatattcttatactgggatacaatctctttcatatacttctgcgcttctttttcctgggtgcctttgatactgaaatagctgacaccgcctgccatcacaagaatgacgctgacaatcgaaaacagggcaaccgctatggtgatctgcttttttacttcctctctggccaaggtttttcctcctatgcatcgcaagaacatcctgatttttatcatacaccataattataagttattcaatcatcacagataataaatggaatttgttttttgatacctggcacgggcgtatatattaccataaaaccggctggcaggccatccagttcttctttaacctgtgcaacgccctctcccagacgcaggcggcggtccagatagatttcacactggcagggaaccgcattgagggaggcgcctcccatccccgtcattggcctgcgccgtatccatgtgggaatcaaaatgtatgaccttgcctccgcttctgtcctcatagtacggacacacaggcccaggcgcgcatccatggcagtgactccgtccagaccataccggccttcatcagcggacattgcagcgaaccccttaccattgacaggattgccagggaggtatccctaagctccagtgaatgctgccgcctgtttaaaaggaaactggggacaacgcccctgcagtacaggaagtccgcattttcatgaaaacggcccggaaatggcggcaatgtttcccaacaggagacatctgttcgtgtttacggcacaaatacattttatttaaaaatgtccgtctgatgcggatattttctcttgatatttggtctgtctgcccttataatggagatataagatacttggaaatgagctgtttttttcacactcgcatatgtagcaagggggttatatcatgcaggatcataccatgtgggctttaacaaaaaaaaagccggaaaccggactttggatggagcgtgtcccggttccggaagtaggaccaaatgatgtgaagatcaaaattcacaaaacagctatctgcgggacagacgtacatatctatcaatggaatgagtgggcgcagcacacaattccaatcggccttacggccgggcacgaatatgtgggggaaattgtggaagtcggttccggggtggacggacacaccgtaggggacctggtatccggggaaggccatatcacctgcggcaagtgcaggaactgcctggaaggacacaaggaaaactgcagggatgccaagggtgtcggcgtgaaccgtaacggcgctttcgcggaatacctggtgattccctcatccaatgtatggagctgccgcccgaatataccggaagagctttatgcaatattcgatccattcggcaatgccacccatacggtccgctcctatgacgtgctgggtgaggatgtgctgattgccggcgcaggacccatcggcatcatggccgctgccattgcaaagttcagcggcgcccgtcatgtggtggttacggatatgaatgaataccgcctggacctggcaaggaagctgggagccaccaggaccgtgaacctgaagcaggaaaaactgagggatgtaatgaagtccatcgggatgacagaaggctttgacgtggggcttgagatgtccggcagcccggcggccctctccgatatgatcctcaatatgaaacacggcggcaacattgcccttctgggacttcagggacgtgaaaccattgtcaatctggaaaccgtgattttcaatggcctgaatatccggggcatttacggcaggaaggtttgggatacctggtataagatgaccaccatgatagaggcaggcctggatatctcccagatcatcacccaccgttttgatatccgcgactatgaaaagggatttgaagccatgatttccgggcagtccggcaaagtagtcctggactggtcccacattaacgaataaccatattgaaaaggagatgtaaagatggcccgcaagaatgatattttaagtatttatacaaaagaagtagaggaaatcagggaagccggactttttaagggtgaagcgcccattgcctccgcccagggcgcccgggtaaaactggaggacggccgggaggtcatcaacatgtgcgccaacaactatcttggccttggcgacagccagagactgattgacgcggccaagaggacctacgatgaaagaggctacggcatggcttcggtccgctttatctgcgggacccaggacatacacaaacagctggaagaacggatttcccatttccttggaacggatgacaccatcctctattcctcctgctttgatgccaacggagggctgttcgagacaatccttggccaggaggacgctgtgatcagcgatgagttaaaccatgcctccatcatcgatggggtgcgcctgtgcaaggccaaacgctaccgctacaaaaacaatgacatggctgaccttgaagaacggctgaaggaagcggatgccgccggagcaagggttaaactgattgcaaccgacggtgtgttctccatggacggcatcatctgtaacctgaagggcgtatgcgacctggccgataagtacaacgccctggtcatggttgacgacagccacgcggtaggctttgtgggcagacacggccgcggcacagcggaatataacggcgtggaaggccgggtggacatcattacaggcaccctgggcaaggccctgggcggcgcttccggcggatatacatccgggcgcagggaaatcatcgacctgctccgtcagagaagccgcccctacctgttttccaacaccctggctcccgccatcgtgggcgccagcctggaactgttcgacatgctggaggaaagcacccagttacgtgaccatttagaggagaccaccgcttactacaggaagcagctgactgacaacgggttcgatatcattccaggaacccatccgtgcgtgcctgtcatgctttatgatgaaaagctggcaggggaatttgcaaaaaggatgatggcaaagggcgtgtatgtggttgccttctccttccccgtggtgccaaaaggcaaagccaggatccgcacccaggtctgcgcaagccataccagggaagatattgattttattgtgaagtgctttaaggaagtgcgggaagagatggggcttagctaagacccggatgatttttccgtaaacaggcggaagaatcccctggtccgtgaccggaccaggggattcccatatccttaaatatattcttcagtatatccttcaatccttgattccctgcagtatgtttccctgtaatccacccccgccgtccctgccccggttcactggcccggcgcctggacaatgaaattataaaatacggtcttatcctccaattggaatactgcgcggtaggtacctgacggaacacctgcaggtatgttcaccgtgaccactccggtccccgaggtacctgaaaccgtcacaggatctgatatcgtccactcatctgctttttcagccgggcctattgccgtatatccctcttctgtctttttcctaatccctgcccttatgacgtgggatgaggattccccgtcattgtcaatcctgtacacggcgttaaattccaagctgccgccagcatttgccggaatcacgcggctgccttcccctaaacttaccataagcccataggttggattgggccggacatcgtaagatgcctggacctttgggattgctggcgcttttacgctgcctgtgttcatcccaaccgggtaaacatccataacaagtaaatgattaccgtctgacaggccggaggaagtgcccgtatccatgatgatttcctcaccggattggattccgggcagatagaccttgccgcctttgggataatattttattcctgtcctgccgatggcaaagctggttccttccggaaatcccgggcttccttcaccggaagaaataaccgccgccatctccgccagacgtgtatcagcatcaacagaagcagtaagggtaaaggtatgtgtgcctctggaaagcccgcctgttcctgtcagcctaaagtttggaacagatgatactactgtaaattctgctttttccgtaggtaccgcagcattatcgtcctgcagcaccagggcatattccccttcccccagtccgtctgtgggcgaaaaatccacgatgacggtaagggactcatgcagcatgccaaatttattgccaatgttggtatgccacatttcctggaattccgataaggcaattgccccatctccatccgatgcgtacgtataatacgctgtccccccggccgttgattcgtctatcagggtcacatccgtacctttggggaaattaacacctgcaccattcttatcctgtaattccagtaaaatcccatctactgcccctgccttcctgatattgaatgctgcggtcacggaactattaggggaaatcactacatagtctgatggaatccttgcattatactgctttcccgccgctgccgccgccccagataccatagaaccctcccaatggacaatcacggatatctttaccagaaccccatcggtctggctttcatctttgaaggaaaggacaagctctgccggttcccggcttgtaaatgcttttgcattccttaaaacaaatttgatggaagcatcgtaacgcccatcggtggttcccaatgcaacctcattgccttgataggcagctaaatcaagcggtgtatccattactcccgcctcccattccccactatggccctgcaccggctgcattgtaatcgcaatctcatcatttaagagttcatctgtcccctttttcatcgtcacgccagatggaacctcaacgccaaccaggcttaagggccgctgtgctcccttggggattatgaactcggccgtgtatgtcccggactggctggcaaaaagttcgattcccgaatcgtccagggcgctggcttttgttatgatatctgcatttatttggattatttcatccggagtaccttctttggtctgcctgacggtaattattacggttccgacatcctgactttttgaaatcagatgattggcataagtcagatagaaattaagctgcggcgtctgaatccctgttgtggctgaggttgtctcagctccgataatcgtattggcattattacttagaatattcttacttgagattacttttcccgcgtttgaatcctgaaagccctccccggtatccatgaacagaccgaatgtggttgttggggcttccatcatcctgcttttttctgtatccggactcccttctggttcctcatttccagtatatgcccaactcccgtcagacttaagggctgcctctgtaagaactacactgcctttgatttcaattgcttcaatctgatactttgttcctgcttcaaccggcggcagcgttaccgtgcccattgtccctgtaacatcctcatcccctcctgtatcctgagcagtcagcacggtctggcgcagggctaccgcatcggccccggacattttccaataacggtaatccggttctacgttgatatagggaagttcgctgtctccttccgctgcacccatggcataaaatcccccgtccggatgggcaggttctggcatatcccctggttttatacgtgcaaatacggtggcggcagccttattatcagccatcaggaaagaataaccgtctaccttgccatatgtttcagatgcatcataaacattgccggttttaaatctgcatgcgatacgcagtactgttccggatgtaaaacgtatggtattcccaacctcatgcagtttttccagagaggtgattgcggttccggatgaatccacacttttataatctgcaatctcaattgcatccgaatcaaggaccagcgtacttcccccctgtaacacaaggctgttgcccatatccccaagcttactgtttccatccccatccatcttggcgttgccatggtttccaatccggttcagggaatagctggcctgctggttctcattggccacgtccttctggccggacagccgcacatgggaatcaatgaggcgtacctggtccgccctctggatggaaaggatttttcccgccacctctgctccggaactgcttccaaacttctccaatgtaaccaaacgtacatcccctgcatcacaggatgccccgcttccgaacaccccaccttccagagtcatcttcggattaccggaagagctgtcaaaggcatatccctctccgtcaatatatacatgcgaatatccgtttactgtaattgtttcatagtcctgcctgccgtctccatagtcaccgcccgcatagaccgacccgcttatggaaagggcattatctgaagacagtcttgggttatcttctgtgtgggatgcatagtacttacattttccaatagcgcctgctccgatatgcagatgtgtagaaccattaacggttccacggtagcttcccccaaagacccttccatttacggttcctccaaccagattaacaaaaatcaggtcctgcttatcgcctcccgtcacatcttctccttccaacggcccgtcattcccccgctggctgcctccatacaggttcgacacggttccgccagtcatgttgaccgtggcgccgcctatgacaaactttcccggtaccccggactcatccaccttaccctgggcgccgccaaagacggatttaccgattatcccgctgacaatattaaccgttgtccttccctctacgattccttccttgccgcctccgtaaacattctcctgtatggtcccgccatcgaccgtaaccatggtgtcattcttcacaatcccttccctaccgcccccatagacgtttccccagacagtcccgcccttaaccgtaacggctgtggagcccaggaccgaggcaacctcaccgcctccatagatgtccccttccactatgccgtccaacagatttacagagacagttgagccaggttccacacgggcgcatttactatagtcaacggagtcatttaccttattaatcccctgtccccctccgtaaatgcttccttttacagtacctccctgcaggctgattgtacattccccattcaggtaagcgttcctctggccgtattccaatttatgggaatccttcgagccatcatatcctttaccgcttgcataaatattaccggttatctgtgcattcccacttacggttatggcagcatgaccagttaaactgccgcagtcctgcgctttcccgctgtccattatagttggagaggtacctgagggcgtatattggctcacttccctggagccgcctaatcctgcagcataaatattaccgaccgtgccgcctgaaacagatatgtttacctgtgaaggagtatctttctccgggctgattacataagcagcagcgcctgaaccatagatattggttacatttccgccttctacgtttatatccagactgcctttataggtcggaaggctgactcccctgcctgaacctgccccataaacattcgtaacagtgccgcctctgatattgattgcagtattgcctgtaaatgctgcattgccgtcattaaatccctgatttcctccaatgagtgtatctaccttcccatttccctccacattaattgttgcatttgcgtttaaaataggaccactggcacagcccgccaacacggttgcggcatatgcattccctgttaccgttatctcagccctgttcttcccttccggtaatgcgctgagattgccggatcttatatatcctgctatcctgatataccttccccccgcaacatagattgatcctgcgccatttggtatatcctgccttcccgcgccgtacagatacacttcggtattggatgccgcagacacggtatcctcaacccgcaaatcatatccgtccgcatatacatggcctatcttcccaaattccagattctcaaagattacctttgcggtcaataccagattccgctcctccgtgctgctgccgctggtgctgatgtttatcttggaatccccatccatccctctgattgtgaccggtactgcattaactgcgggaaatggcaatgatataccgtctgatgtagtaattacatatgcctccataaggataatctgattatccgcagccgaatccgttgtctggcctccgttttcgattattttccccattgcttttgaaatcgtttgaaaaggcttcccctgggtaccatcgccattatcatcgctaccactgccggccgcaacatacatcgtcctgcctgcttctgctgccggagcggttgttgataccggctgggaatataaaaccacatctgcgccagccggacgggtccgcagcaggctgattgcagtcaccttacagcggaactgatttgtaccttcacctttttttacttcccgctgataccgggcctcatccgcaccctcgatatcaatccagatattatcctcatccagggatttttccgcctccgaaggtgtggcgttaaacggatcatcagattgtgtgatatctgctttatccagttccgcatcatccacatgggcggtctgccactgatataaaaacttatatctgcccggaacttccagcgcctcacctgtgctggaatcaatcagtgtgtaaattgccatcccgtcctctatgttcaaatcaacgtctaaaggatgcttttcaactgttttccaggatgaatacaggtctacatggtcatcctcctggatatccagatactcccccggttcccatatcagcgcatccccttcctcctctttcactgtccatcctgtaaatgaattggtaaaaaagggatcttcctcatatgggcctgtgatttccagcgggcattccggcagcagcacctgattgtcccgaacaggcagatccatctccattataccgccgtccaatgtagcagcagctatccggtctgccaattggtatcctgcgtattcagctgattccataaaagacaggttttcttctgagcaggtaaaaagccctgtctgcccttcgtaaaaaagactttccgggttttccaccagctgctgtgtaatataattgactgtataatcctttttcttttccagttcatcctccggaaggggggctgtctccggaaggggctttgtttccgcttccacatgttcgctttcctttggagtaaggctttcgtcctccatggaaggattggtccccggcacctcctcatctttggctccgcccccgcttccatggtctcctcctgcgcctgacgggccatggcttcctgaaccatttcctcctgcgcctgacgggccatggcttcctgaaccatttcctcctgaattgtctccttcgtcattctgggatggctggctttcgcttttatcctcagtaccgccggataaggcatcgtcttccttatccatggatgaaccgtctccatccggggcgccatcattatcaggcacattgcctgtatccgatgtattgctgcctcctgatgtgccgctgtcatcccaggcattgccttcatctgaggggccgcttccgtctgagatatcatctccatctgaggttctgcttcctggggtactgctttctcctgagatgccgcttcctcctgagatgctgcttcctcctgaggtactgctttctcctaaggttccgttacctcctgagatgctacttcctcctgaggtgctgctttctcctgatgtactgctttctcctgaggttccgtttcctcctgagatgctgcttcctcctgaaatgccgcttcctcctgagatgctgcttcctcctgaggttccgtttcctcctggagtgccgcttcctcctgaggtgctgctttctcctgaagtgccgcctccttgtgaggttccgctttcttctgaactgcttctgcctgacgcgctgctccccattgatatgccgccattgcccgatgaatcacttccactgttgtccgcagattcatcagcaattcctaatctgggaaccctatgttccgtaattcctgcagccgttaaatttaaaggttcctcctccggcttatcttccgttcctttcccccttgtctctgcctggttctcttcccggctttcctttgtctctgcctggccctctttctcctcctggctttcccttgtctctgcctggccttccttctcctcctggctctcttttgccccagcctggccttctttctcctcctggctctcttttgccccagcctggccttccttctcctcctggctctcttttgccccagcctggccttctttctcctcctggctttcctttgtctctacctggccttcttctgtcccttcctgttcttttatccctgaccagccttcttcttttccttcccggctttccctcgtctctgcctggccttcttctgtctcttcccctccttcatccctttcaatccggttctcttttgtctctgcctgcccctcttttatattctcatcccggtcttcccactccgcaatttcaccgccctcaaattcattgacaatgactgtaaatcctggagcattttcttcatcttctcctgaaaatgcatattccccaaatccaacaatgctgcccggcagtaccagtttgccgcgcagcccgccaagcccataaaacagatatgagccaatatgggtaatcccatcttcaatcaccaatgtgtggatttcatctgaatatcccaaaaatggagccgtatcttccgtatagtcctctgtatccccatagccttttatggtcagcaccccatcttccagttccgctgtcacatcagcgcctatgtcaaagatttccggggtctcttgggttgcataactaagtatggagccaaagttcatattcgtcagcagcaggctgcatataagtactgccgccaatatcctctgcctgattccccctgtctttgtcagatgttttttgtgttgtcccatacccatgaaaatccctccagtatccacggcaccgcgctgctgcctgatatctatttttatgaatacacttacttactgtttatcgtgattttatccgcaaatgtttcccctgatcctactgtaagttctgttgttttatctgatttcagaagaaccagggaatacacgccatatcctggcgatgcaaatgtacaggtggacggaccagaggtatacgttaccctgtcatctgtctggtccgggattacatcacgcggaagctctatggttatattttttgcagaatcagcacaggtcatggtcagtacggccgccctgtttccagatgcatcctccatgctggccaggttcccgctttccctgtgaaaggcagcagtcagtactttcctatatggttttgaagaagtaactgtaacaatcacgtcattcgctccagcatccggcgttatggtaagggttgccttctgtgcggtcacggatcccggaacagtacctgtaaccagttgattaccagatggatccatacattgccctccatccgcctccaccccgtactgaatcgttcccggcgttattctaagggaatccgcatagttatacagctcaatggaaatattgctgtccgggtcaatgaagtattctgccttttctgattcttcttttaaaaggtcgcttataaaataaaaatcttttgccgccaccaggccgcttccacgtttctgcatagtataacgggcagcggcaattccagcaagggccagtaccatgacaacaatcatgagtaacagcagggagaacctggtccgctgtttcattctatctgctttcatatccatcgtccccttatttatcatccggaattatctgttctgcctttaccgtaaccgttaccaagtcgatttcatccatgtaggatgcttctgttttttcagccggccatgtaatggttaatttatatagatgggaagcttccctggcatacggaagggttcctaactttgtataggttccgctggcaagctggacaggattgcctgccctgcccaatatggaggttccctccccatctgccacattttcagccagaaccagcgtaaactccaatggaatgtttcccatggtctcaaccatgatggaatactcctgtcccacctggctaatcctgccatcctttttattcgtcactgcaaatccatatgttccatctgctcccggcgctaaatcctttaaatcaatggtaaagacagattccgctccccaggcggcaaccgttacatcagaggtcatgctggcctggctcttatagccggcataggataaggatattacccccgtgcttactgccgcaagcagtacaagatacccaatcatccgggactttgtaagctgttttttcattctgatgttttcctccctgtttcctgcaaaaggccagacaggtcactgccccaaaaaagcagtattgacagcaggacaattgccagtttcccgaccggcttcctaaaaaacaatacagcatatccggccccgggaatcacagctgccatccttccgtgtatgctgtcccctgcaacaatacccccatccggagcattgttagaatcgccttttgtcacaaacccttccggcgtttcttctacgatacggtgcgttatcagatttccattttccgaaaatgtaacgatatctccgggccggtatgcatcttccttatggactatgattatatctccagctgaaacaacaggttccatgcttcctgacattacaaccgccggataccagcatgatgaagacgggtatgctttgtggaataatacctttgcacctatctgccaaaaattaaggattacaatcagaccaagggctgccgcctccattaaatagaaacatcttcctattattttcactgatgggccgcctcctttatgtgttcatctatccgcgccttctgcatgtacggtcaaaaccagcatgtagtccttaccagcttttccggcctctgtgtccgcatgttcattcccttcaaagggccattgccagtccagcttaaaatccttttcctcacctggtcctatctctgtttccagcacaagccctgatccatccctgcccagtgttcccgtagcagttcctgtcttatccggccatatcccactgttttgttgagtcagcgtaaatgataacggcagatggacctcaccctcagtcatgataaggcgtatggaaagagactcgtttctggtgtttttaaggcggaattggtagtatccctgtgaaccgggtaaaacaggctcctgcggaccgccctcccggttgtagaacaggtctatgccggaaagctgtgtccatgatttatatcctgatgtatccctctgcatctccagcacatccaggattcctttatccgggtccgctgtggtttcaggagggctttcgggaggtgtattcccgctgtttccactgcctccgttgtttccgccgcttcccccactgtttcctccgcttcctccgttgtttccgccgcttcccccactgtttcctccgcttcctccgttgtttcctacacctccgctgtccgcgccttgactttcctgtccttcggttcctccggcgccctcctgtgatttatctgaaggattctcagggatactgcctggaccggatgtttccccttgtcccgcaccagtattcccgttcattatatccggtacgtccatatttatagttccagaagccattccttcccctgcaccggttccgtccagactgccgccttgcaccgtaccagtctgggatgcctgttcctgtgccccgccaatgggccggacctcctgccctgacacaatcacccctccggttcccggatttttaaccgtcccatccggtatatggatttctccatccggaccaatgaccgtgccttggggaaggtttaccgtgccatccggtaagattgcagcattcccggcaacaagcttttcctgagggaaaataacagtatcgtccggaaggatgactgctgtgggatcttccttccttttccccgacatgacaatggttccgtccggcagacagacattgcctgccggggtcaccactgccccatccgttatggaagcccttccgtccggcgtcaccaccatgccgtccgttgtggcgtaggtgacattttccggattaatataatagttatccgcatccagttcaatgtacatctccagcatccgcacatccattgcaagttccaccacataaacgccttccccattcaggtcaacggaaatgcccttccctgcttgtgtcctgtctaacaccacattcctccgggccgccattgtcccgtcatcattcatcacggcaagactgtgttctcccagggggacatggtcaaacaaaaaggcacctgcggaatccgtcacggtgcgtatgggttcactgtgcagttccagtgtgcgccccgcggccggggtgccgtctgaatacaacacgcggcctgtcaggtgcaggatggcacttttttcctgttcagcctccggcgtcagaaggatggtgtcaatcaactggccgctataacgtatatcgcttttttttcccagaacgtatccagccaggctggatgtacataatgtcaaaataaaaatcaacagaagaaatggcggccttttccgtccctgttggtccttgtccccatgcagggacaaaatgtcccttcctaatcctgtcatctgttttatctcctatcacaataccggaatctgttcagtttccggcaaaaagcaggaatggattcctggcttttgccggggactgaatgcccccgtccggttccctgtccagcacagacggacggggaatggatggcctatggtgtaggtgttaccgggattatctgttctgcggacaatttcagggtaaattcctggttagcaggcggtgtcatacctaacccggtatcggctgtatcagtatcggtttcccaccgccaatatattgatccctcaagtcctctatcagcggcatcagtggcatcagcgcccactgtcttattggcaaccttattatcctttactatacttgctgccgaaaagtcatcacttgtgtaaaatttgataacagcaccaatatccgaatcaagctgacttgtatcaagttccactttgcatgtatatccaacctctgtacccttatcctcaatcacatattttatctcgcctgtatcccctggtgccacgacatcggcctgtacattgtcattcttcttttttgtacccgccagcgtaaagtcgaatgtactgccagatatatcatttccctcaatatcttttggtgtaacaccccacttcgctatcgccaccgtaccggtgccttccgcttcactgacatacttagccaacgtacttcccatcatgctggtggtaataagggtcagcgccagcgcaaatgcacccagttttaccacattattccttctcatacacacttgccctctctttcctttttgtgggaccaatctgcatttgtccaggcacggtccccttgtgcctgtggcttctatgcacacccggtgcatctgcccggttttctaaacagcctgctgccccgctgtgcccgggacgcaggactggtgcactcatcatgatctggttgtcttcccctcatccccgggagttcctgacccgctttccagctgctgcttcatggcttttatctctgcctccagcctggccttctccatgacggcctgcatcatctgctgacggtcggccctgcgtctgagccatatatcaattatgatatataacagcaaagggcagataatggtgagaaccatgcccatgggcgtctgtatggccatgattttatggcccagacccggaatccttcccccattccagatgccctgtacctgttctgaagtcacaggcatacggtcttccgcattattggcatctcccctggtgatatacctgggctgcccgtcctctcctgtggtaacccctacgattctatgggtaatggctttcccggacaaaaggtaacatatcacatcgccttcctttaaagtaccagggtccgtgctgcggatgaatatcatgtcgcctgtctctatgaccggttccatggaaccagacatcaccacagccggcttgatgcccaatacccccggcagttcccccggatttatgtagctgctggcaatcagcacaagattaatgaggatgatgggaatgaatgccatacagagcacggcccctgtcactccgggaagtgatatcctgcgtgtttccttttccattcagcattacctcctttggtgatctgtcccggattctcccgcagtttagggataaaacgtccccattccggaagacactccatatcttccccctggctcagggcttctgggaacacttccaccgtagacttatccatctgcgcatcatcccctctgtcatatccggacaacaaaaaccagcttcatactgcaaagctggtcttatattcatatacaactggctggctttccttccgcactgcggaaaggcgaaacccctatagctttgcgacactgcctttcgacagctatgcccggtcttcaattgtaaatcaccgtatatgtgcagtccaagattcaattacattccaagaatacttctttttacaataaataacaatacagcgtggtcttttggcaatgccatttttatgtcatcaaagatgacacattttcctgtcatgcaacctgccttctaatactgctgcgtcatatgccaccggattgttttcctcagccctgtgtccagatcataggacggtacccaccccatttcttctgttattttagcagtatcagctgcaggccattccctgtcctttcctctatcattaccataacagataagtgtttcgggcctgcccagtatctttaagatggtacgcaccacatgtgaatctttctgcaggctgttactgcagatgtcatatgtccctccatccttcccttcattcacaatcaggtcaatggccctgcagtaatccgccacataaagccagtcccggacattttcccccatattctccaggtaaatccgctcccctgataacgccctggcaatggccatgggaatcaggctgtcttccctgctgcaaggaccgtaaaggttgcagcagcgcgataccgtgaccggaagtccatatgccgcctgtattgatgctgccagcgttgaacctgcctgtgccggcgcctctccttccgatacctggtggtaatgcctgattccaaacagccggcatgcgtccagaagatttttaacccctgcctcattatatggtacaaaattaatgacaatccccggcttttcttcggcaaacagattcaatacaaagtccttgtccccaatgtcaccttttacgaaccggtaaccgggtatatcctcaaatggcttcagattgtccgcattggctgatatatccagattgaccgtatcattgcccggatatttaccgaccatatattgtattaagtggcttcctgcaaacccggaacctccggtaataattaccttcataaccatccccctgcttcccattttgatttcaggatacttctttttataatggaggacaataaagtaacatcttttggcaatgccacttttttggcattcaaaatgacacctgatttcattgactcaatatagcgaatggaataatatataaaagaaatcatcacgacaagaagtggggaaatctatgcaattttacgaaaagcttatatttctgctgaacttaactcaatccacaaaccgaatactggcccacgaacttcaggtagatccttctctgataagccgtctccgcacaggaacaaggggtattccacgtaaccgtgagcacataaaagccatgtcctcttattttgcaaaacgctgcaccactgaataccagcggcaggcactatcgggaatgcttggcatcaggcaggcctttacaatgaagaaagaacagctttcagaaattctttatcactggctctgcggggagtcggacgagattggccgtttcataagaacctctgaatccattacagtcagtgcagtgactccagggaatactattcctcccttaaatgccacagctgacaatactgcttattatgggaatgaagggaaacgtgcagcggcccgtgcaatttaccatcatctgctctcacttaaaaagccgtgtacgatttatatcatggctgatgaggcggataactggatttcagaagattatgaattttcccaggagcttcagtcatggggcatgaacctgaccagccgcggatttcatttatgccacatagcgcctcccgcttaccctgtggacttagcctttgattcactgctccgctggattccattttacatgaccggacatgctactgcttactattatccgcgtctgagggacaatgtctaccggcgtacccttttagttgtcccgggaaacattgccatgttttcaaactcactggcacaccagaccacgggaaccgctgcaatcgtgacaacggataaacggctgatacaggcctgctccgtacagttccaggattatctgtccctgtgcaggcctatgctgaacatttatacggagcctgaaagcctgaggcactgttttacccgttttttatccaccgaaggggcgcgcatccagaaggtcaccaccctgtccgcagagacaacccctccggaactgatgtacctgtgtaccggaaaattcacacggaccggattaaaaatgcttggaagcccctatctacataatatggtccagatagaagaacacaaggatatttccgaattcattgatatcgcctatcttgccagtgcccaggaggtgagaaacggaaatgtacctatcatactgtcctatggtaaaggctcatctcctctctgctataccccggagacttatgtcatgcaccttaagaatatacttcatatcatggacatatacgataattaccattttgtccccattggaaaggaaatggaaaaagacggcaccatcctgataaaagaagggcagagggcccttctggtacattttgccccacttcccaacaatgctgcaatttccgtctttgaaattgtccagcctgaaatcgtccagctctgccgggaacatttactcagaatcgctgaacatatcggatatgccggtgttaacaggtccaaaatcatttcccaaatcaagaaacgaatcagtgagcttcaggaataaagaggtgacgcggagtttaaataaaaagtggagagcggcattgataaccgttctccattttcctgccgtctttttccttttaagcgcctgttgaaaaataccatgtaaaactgtataatcaaataaaactgacatgcacatccataaaaggttggttcggatgtaatacgaaagtgtggtttaccatggacaccaaacagattgaatatatattaaaaatagccgaagaaggcaatatcacccatgcagcggaaaaactgttcctcacacagcccgcgctgaaccagcagctcctgcgtctggaaaaggaacttgggacacggcttttcgtacgttcccgcaccgactggcgccccaccgaggcaggcagggtctacctggaaaatgcacggaaaatgctgcagctcaagcaggacacctaccgcatcataagcgacatggtttccgaccagaagggacgcctgtccatcggctttacacccgggcggggaatccacatgttctctgcggtataccccggattccaccggaagttcccggatgtcattgtaagccccaacgaactgagcgtccataaacagcaggaattaatcagccgcggggaactggatatcggctttatgactctcagtgaagaccacaagacaggcgatacgtatatccccattgcaacggaggaaatctacctggtaattcccggcagccacccattaagcagcctggcgcccaaaaacggtcatgccgccctggacatctcagctgtccgaaatgaaccatttgtgctgatgtataaggaatccaccatccgctccctggtggatggtatattcgcccaggccggatttaagcccacggtcctgtttgaaacctccaacaataacacaatccttaccatgatacagtccaacctctgctgcgggctgcttcctgcatattatatacaggacaaccccggtggtatcacctgcttccagcttcccaccaggccggtctgggaggtggtggcgtcctaccggaaaggcagctatctgacccaggctgcccggtatttcattgaattaacaaaggagcactggaatccatgactgattccagatgctccttttccatcaggtgattggcgctgggttgaagatacataaatcattatgaagcctgtactgttccgcaaagcttttcctgcgtccgcttgccacatcgatgatttccatgaacagctgtgtccctatctcaggaatgtcagcctccccggttgcaaccgggccggcgttgatatcgattaaatcctgccactgttccttcatctcattccgtgagcagacctttatgacaggggcaatggccagtccataaggtgttccccttccggtcatgaatacctgaagcccgattcccgaagccagctggcagggaccgcagacaatatcacttgccggggttgccgcgtatatcaggccctttttggaaggcttctcagcaggtgagagcacttccacaatgggggaggttcctgatttggcaatggaacccattgctttttccacaatattggccaagcctccctttttgttgccgggggtggggtttgcgctccggtcaacctggcccgcatccaggtaattatcataccacttcatctctgcggccagcttcttccccacttcttcattgacgcaccggtgtcccagcagatatacgccgtccctgacttccgtaacctctgaaaacaggaccgttgcaccgccctttaccagcatgtccgccgcatatccggcagacggattggccgtgacccctgaaaatgcatcgctgcccccgcactgcataccaatcagcagctccgagagagggagtgtctcacgcttacgccggttcaaaattgccagcttcttttccgccatctccatcagcgcgtccaccattgcattgaaaccttttatctcctggaggatgatcacattctcaggacatatatccgcctcatccagaagcatttccacggtgaatttctcacagccaaggcccactaccatcagctgtccgccaaaattgggatgctttgccaggttcctgagtgcccgtatgggcacctttgcttccggcgcattgatggctaccccgcatccatatgcatggttcagggggacaatgtcatctacattgggatacttggggagaagttctttcctcatcctctccaccgccacgttcagcacaccggtcacgcactgcaccgtggtgctgattcccaggatgttcctggtgcccgcagggcctccccacgggttgcggtaaccttcccagacagtaaccggaggctccggcagatccgttaccagattcgtggcaaattccatatcatccacatccgggggcgtgggaagctccagcatgtgttcgttaatccaatcgcctttttttatccggctgacagcatatcccaggactacaccgtagcggatgatctcccctcccttttcaatgtcgcacagggcaatcttatgggcctgggggatgtcctggtgggcaatgaccccatccatcacttctgtccccgccttgatgtccttcacggcaatggcaacattatcctggtctttgatttttatgtacagtggctcgttcaaggtatttcctcctattatttagaatctgacagttggaagcggatgtctccgccaattgattatctttatcatatatcattccaaacaataagtaaaattgataattgttttgtatctctaattatttgttagagttctcaggccattatatcccggcgctgaatgacccaatcctgtttgtacccaactgcaggagcgcacagctgatgatgccaatgctgatttccgccagtataagcagccagaataatcccgccggcttattaagtgtatgggtagacaaagcatgtgcaaaggaaatgattgcctggcacaggtaaacgtagaatccggtcacaaattcattttccttcccgatgggaaacttgtccaggagaatgatataaactgcccagaacacccctgaaagcaatgcacatataatcccggttgcggatgtggaaaaactgtcccagcttataaaaacaacacctgcaacacttgccagcaatgccagccccttctgccagcacagatgctcatgaaataccgtcaccagaatgaatgtaatcactgcggggtaaagggatccacctccatatatccttcacatggatttccgaccgccacgtacattatcttcctgtttaaatcacagaccgtagaagtaagggttgcaaaatcctctgcatgctggcagatggatgtaggataattcacactgtggtctgacaggatatccatcaaatccttttctgaaagctggtttccttctaatccgcccaccagtccagccagcctgaaggacctgagtttatcttttggaaaccagtccgtctccctgtaaggcggtctgggaagtttaggatggcaatagctgttggcatggcatatactgccgttttccatataaagcatgccatatcccctgtactccatttccaggttcaccatttccccttctggcccgcagaccataaaattgatattgctcgcaaccctgctctttactgccgcctcgaccgcgtccggaaacgtgtactggtccatgatgaaacgatatgcaaactgaagaggcagaccttcaaagtcaatgggcgcatccgtaaaaagtgaatttcctccaagcccgattccagcagagttcatgccagccatgcggcatatcattcctgcctcgcctgcccaggcaatatcgggcttcccctcctgtttcactatcatgaatacaatggttggaatctgggaatgaggggcatcccagttctggccatacatagtggttcccgacgccgtcctggtgtggttcagtccgaccacggaacagccccccgcaagatgcagggctgtttccgcattcatccccatgttatggctgaactgctgtcccagctccgtgcggcagttcagggtgaaaatatcttcaaagctgtatccagccccatcggcaatgccctggatttcctccagatactgcggcgccatggccctgacagccggaatgaatgcagaggctatcttcctgcacatcccccagtcatgccccgttgtcttttccactcctgccttaagattgtccagtgaaacccctatctgtaccctgccgcttgttccatgggtgaatccaatcccataatttgttccggaagcccggatgacaggaatcttccctgctatttcagttaaagacatatgcacatttccctctccatcagtatattatcccgcataaacctgcggtctgcggtccttccacggtttagccctttcgagctgggccgcaagacttaaaacaagggcatcattcccaatccgtccatcaatttcaattcctatgggaagcccgctcctgcttgtttccaaaggtattgtaatggatggctgtcctgtcacattgcacatggcggtattccccgaccaccgtctgcgctccaacacccattcctccactgtcatgtccggcctggaaaacggattatatacccctgccttaaggggaaggattcccatggtgggggatacaatcaggtcataatcctccataaaagcacccacggcccgcattacggcattcagttctttccaggcagccgcatattccctggccgttacatttcttgcttccagataagctttataaaccaatggttccagatattcggccgtaaccggaagcccggactgccttgccacgctgtcaatccatccgtttgtcccaacagattgaatcagtatcctgggttcatggtaatggatatcaagaggaggatatgcttccacacattcatgccccaatccttccagcagctttacggttgatctgaccgcctcaagacattcctcattttcatacgttcctccatagggcggatggagcatataggctatcttaagctttccgggatctctttggatgacatcccggtatggaacagccgggtgcagggccgccccatagcttcctgcatcaggcccctccacctcatccagcatgattgccgtatcccttacggaacgggacagcatgaaatccgcggaaagacccgggtccccgtcctcaggccccgtgggaatccggaaacgggtaggctttaaccccacaagcccgcaggctgaggcaggcatcctgattgagccgccgccatcgcttccatgtcccatgggaacagccccggctgcaacgacagctgccgtccccccgctggagccgcctggtgtcagttccgtgtcccatggattcctggttattccatgcaggattgtctccgttgcattattccagcaaaactccgggcaggtggtggttgccaccaccacaatacctgattttttaaagcgggcagccagttcactgtcacttctggcataaattccccttcctgaaatccgggaaccgaccgtgcttctgattccggccagaacatccccctgatcctttatgacaaatggtacgccgcaaaaaggcgctgataaatcaatgcctgcatcaatctgtgcctttgcatattcgtatgtctcatccacaaccgcattgatggatggattgacctgcctgattgcctccaaagccgtatccaggacttccgagggcgatacttccttttttctgattaatccggcaagtgctgttgcatctaatgccgagtattcagataccttcataatttacctactccaatcttttgtttattctgcatatacagcaggtctcctcttaatccatggcctggctctttcaagctgcgctgccaggctgagtaccagctggtcattgtcaatcgcaccatccagctctatccctaaaggcataccatccctggtgatatacagcgggagtgagatggatggaagtccggcaatattggccagcggcgtaatgcaggcatattcccgcctgcgaagggcccactctgatgcctggataccagaatccaccaccccgttcagcattcccagcctgcgtcctgccttccccaccgtggggctaagcacaatatcatagttttcaaaaaaacggcccatcgcccttgcggctatcccaagctctgcctttgccctgaacacatccattcccatacgcttttgtgattccagatatgttttatacaccaatggctctaacgtggattcatccgcagtaagcccggtaccggcggccagttcctctatgctgaccgctatctcatcacacatacaggctatacgggcttcatgatagctttcccggatatccggataggcttcaatgcattcatgccccaatgagcggaggatttccacggcttcctttaccgccaggatacattcagggtcgctgaattcctttccatatggggtacgcagcatgtatgctatcctgactttacgcggttcacaccgtactgcctctgcgtacggcatgccatgcggagccgccgcaccataatatccgcagtcaggcccttccacagcatccagcattgctgccgaatcccggaccgaacgcgaaagaatgaagctgacagaaccaccgggatcccatccataaggaccagtagggatcctgaaccgcgacggtttgaatcccacaataccacacatggaagcaggtatgcgtatggagccgccgccatcatttccatgggcaatcggcacgcctccagccgccaccagcaccgcgcttcccccgctggaaccacccggagaatactccaggttccagggattgtgcgtggggccgttgcgaagtgtctctgtagaagaatcaatacagaattccgatgtggcagcggttgccaccacaatgataccagattgtttcagacgtttaaaaaaattggaatcttctttggcatacaccccttttccagataacctggtccccattgttgcccggattcccgcggcttccccgccacagtccttgagtaccatcggaaccccgggaaagggggatgataaatcaatcccgcccttaatctgccttaaagcatattcatatgtataatccacaacggcgtttaacttaccattaatcttttcaagggcttccagggaagtttcaagtacttcctccggtgaaacctgtttcctgcgtatcaggtcagcaagcgccgtggcatccaggcccgagtattcactaagcttcattctggctcctctccatcattaatcgttctcaaatccagccatctcagccgtgagcattttctcccttgacttatgtgcaaaatgacatgccacgcaatgtccgggtgcaatttcctgaaggggcggctcctgttcaaaacagaccggctcgctcatccagcatctggatgcgaacctgcagactggtttcgggtcaatagggcttggtacatcccccttaagcacaatccttctgaccttacggttcacgtccactttgggaatagctgacagaagcgcaatggaatacggatgacgtgtatcaccaaacaggatatccttatctgcaatttccacaatcttcccaagatacatgaccgcaaccctgtgtgatatatgcttcaccacgctaaggtcatgggagatgaataagtatgacaggtccatcttgttctgcaaatccatcagaaggttaatgattttagcctgtacggaaacatccagggccgaaaccggctcatcgcacacaataaaatccgggttaaggctcagcgcccttgctatcccgaccacctgacgtttccctccatccagctcatgagggtactgcatcagcatatcctttgcaatcccggtaacgtcacagagcgcatcgatggtactgtccaatctttcctttgtacatgatttatgtattttatatgcctctgcgagaatatccttaaccctcttcttaggattaagggaagaatatggatcctgaaatatgatctgcatccttcttctcaattccaggtcctcactcctgctcctgacgtcaaatatattcctgccattgaccaatacctgaccgccggtagccccctgcaggcgcatgagtacggtccctaccgtgcttttcccacatccgctttcccccaccagtccaagggtttcaccctttctcaccgcaaagttaaccccatccactgcgtgcagcatccctgctccggatactttaaaatgttttttcaggtcttttacctcaatcaggttctcttttccgtcattatctgacacattacggacaatgctatcatccatggtttatccctccttatggtgctggcaggcaacatagtggttatcattgattttaaccagttccggtaccgcattttcacattccgccgtacactgcccgcaccttggtccaaaactgcagccctttggcagatgatagggatctgcaaccgcgccaggtattgcggtcagccgttccttatcgtcatccagtgtggggatggcacccagaagtccctctgtatatggatgaaggggatggctgaacacctcttttacggaaccgtattcaatgatggatcccgcatacatgacagcaacattcttgcaaagttccgatatgattcccaggttatgggtaatcatcagcagcgatgtggagtatttctgctccagcacttttatcagttccagtatctgtgcctgtatggtaacatccagtgctgttgtgggttcatccgcaatcagaagttccggattacatgccagcgcagccgctatgcctatcctctggcgcataccgccgctgaactgatggggatagtcctttatcctgtccgcacggatacccaccatctccatcaaatgtcctgcttccttatacgcctcggcatttttcattccctgatgcttcctcagcacaagggccagctgctcccctaccgtaaagaccggattcagagaggtaagggggttctggaaaatcatggaaatcttgtccccccgcaggccctgcatctgccgttctgaatagccggccaggtcctctcccttataggtgatgacacctgacttaatcattgcggacttcggcgacagaaggcgcaggatggcaagggccgtggtggtctttccggctcctgcctcccctaccagtcccaatgcctcccctttatgtatggtaaggctcagattattgatggcctgtttgattcctgtctctgttttaaattccactgtcagattttttatatctaaaagcacattgtccatttgctctcccccgctatcttgtttgtctgggatccagcacgtcacgaagtccgtctcccaggaaattaaatcccatgacagcaatcatcagggcaacaccaggtacaataaccgtccaaggggcaattgccaaaaagtccttgcctgccgctatcatgttcccccaggaagcagtgggaagctggaccccgagataaaggtagctgagacaggattccaccaaaatcacactgccaaagcagttgctgcatacgataagcagggaagtcgtgacattaggcagtatctgtgtgaacatgatatggaaattagtagcccccagcgccctggacgcctggatgaattccctgtcccggattgacaccacctcattgcggcacacccttgcaaagctcatccagaaactgattatcatgacaaggagcagattgaagatactggtaccgaatatggccatgacaacaacgcccagtgtcatggtaggtacacacatgctgacctctgtacaccgcatgatgataacatctaaaaaaccgcccttatatcccgcaatgattccaagcaccacccctgccaccagtgacaggagtgtgccaagaaccgcaaccttcatggaagattttgcgcccacaatcattcttgaaaggatatcccggcccatggagtcagtgccaaggatgtacccatgtgtgccatgggaaaaccattgaggcggaaggaggcggtcagcagtatgatattcattggggtcaaggggtgcaagctggtctgcgaaaaccgctacaaaaatcagtatcaacaccaatgcaagcccaaacatgaactgcttactgcgcaaaaatcgccgtaataatattttcttctgcataagctcctccttacacttccttaatccgcgggtcaataaaggtaatggcaatgtcaaccagcagattcacaatggaaaacatggccgcagtcaccaccaatgatgactggacaaggggatagtccctgttattgacggctgtcacaagcatggtcccaatgccgggaatggtaaatacctgctcaatgatgaccgcaccagccaacatggttgccacttccagaccatagatggtcaccactggaatcagggaattcttaagtgcatattttgagtaaacctcccattttgaaagccctctggcataggcacaggtaatatagtcctcattcagcacatctatcatgctggagcgggacatcctggccagctgtgcgcatagcctgtaactcatggctatgaccggcatgataagataggccggtttggacaggccataatatcccatggaaggaaggcacttgagccatacggaaaatacaagcagcaaaaggacacagacccacacaaccgacatggattgaaggatgaccacaaagaatatcatggaaaaatcaagcccgcttccctttgacacacctgccgatatccccatgggcacactgatgataaacacaatcaccgcggacaggatggagacgcatagtgttgttggcagacggttcattatgattcttgcgcatggttcattgtaaagggttgaatgtcccaggttaccggtaataagccccttgaaatatatccaatactgtacaagatatggctggtccagtccaagttccgccctcagggcagcgcgctggacttccgtggcagtatcaggaagcattgtgacagtgggatcccccggggcacaccgcatgagcacgaacgccatcacagaaaccacccataccactatcagcatataaccgatacgttttagaatggattttaacatttgctctcctcttttcccaaaaatggttaactactttttccatacattctcgtcaacatgtgcataacggaaatagggtcctgcacacttggttatattgacgccctcaaggccttgacgttttacacagtactccatgggagtatagacggccagaatcggtccgcactcttcataaacagtttctgcaacctgcttaagcattccttccctcttaccggcatctatggtcttataggaatccaggataagcccgttcaaatcctcatttacataataactgttatgacagtcatccacgatacgcggaatgatatagagactgtaggagtcaccgtcaaaccctccaagcgtaacaaagaacatatcatatgcactgggatcctggcggattgtaacaaattccgcactgtcacacagcttcgtggttacattaaagcccactgccttcagattctcaacaaacaccgccatgacatcatcgattgacgcaaggtcattacgtgtataaatagtcagttcctcacccttatatgctgtcttagcaagatattccttagccagctcaggatcatacccatacccctcaatggtttcatcatagcccgccagggattttaagaacatgcagttcatggcttccccgccgcctaccagattcagcatggtatccctgtcgattgcgtacgccactgctttcctggcattgatatcactgaaaatggaatcctccgcgcagtcaaactgaagataatgcatgacatcggatacatatcccacaacctcaatgccgtcctgcccttccagcataggaagcatgtccgggcgcagggttgatgcaaagtccacttccccggatatcatccccgacaccttggcattttcctgtgatatgtaccagacataaagggtatcaatattggatacattctccttgtcccagtaatccttattacatgtaactttcagatactgaccgtctacccagtctgaatatttccatggcccgctgccatttatcactttttcggccgactggaaatcatccccatatttctcgatatcctcatctgataaaacccaggtataagaaagggctgtctcgaaggttgcgaaatactgtgtcagatgcagctttaccgtattatcatccacatactccgcgctttccagatacggccatacggcggatacaagtgccagggtatccatattccgcttcatgaattcaaatgtggcaaccacgtcctttgcatttaagtccgtaccatcatggaacttaacaccatcaatgatatgcaggattgcttccgtcccatcctcattaagttcataggaggaacagatacagggcgtattattcccctccctgtcaccataataaagcgggtcaaacaccaggtccgcatagaggaattcgcagctgttattgttggcatacacttccagattaatcaatgtaatgacatcgctcacattgaccacacgcccatcctccttgtccttccctgccgcggctgttgatgagccgtctgccggagcctcaccggacggtgcgccggagccacatcctgctaatgtaagagccataaacagacacatcagtttctttgccatctttttcatatgtaatccacccttctcttttatattgttcagtcatcattgaaccaactacctcaaacatcccttgcactacatggccattcttcacttatccctgataataactattcttatttttaatattaagattttgttactttttggccgaaaatatttcccccttcccccatttattgttttgatgctttttgcacaattttcagttaaaattcttatattgttttactattttaactatagtataatataaacacataccttcgtccaatgaattaaagtcaacactctataaccaaatacaataccgattaaggaggaatgggcatccagatgcaatacaaatcactcaaatacatgttagcccttcaggaagaaagggtacttgcaacagcagcaaaacggctggacatatcccagtcatcactgagcctgttcttactccgcctggaggaagaagcagggacaccgctatatgaccgcaagatgcactgtatgacaaaagccggggaactatattgtgacggcgcaaggaagatccttaacctgcatgataaagccatggatgatataaagacacgtccggacagtaaggccatactctttggagccgatatctgcatcagtgagattgtcccctcgctgattaacagcctgttggaaaaaattgcaatggcatatccgcagctcaggctgcaggtttctttcctcccggaggcaaggctgagggatttaatccagcagaagaaactggaccttgctttctcttacttccaaagaagtgggattgacaatttacggcgcagggaaatcatggcagagacattcatattggttgtaccaaagggatttaagccttataaggccaatccatttacggccctcaacagccttaaatacatatccatgttcagggataccagtatccgttccgcttgtgacgccctgctgttcgtacatggaatttctccatttgtccaaattgagtccggttcctacgccttcacccagtccctgatggaaacaggatcatacaccaccatcatcccgtcaggggcagtaggcctgtttgaacggtttgacctgtatccgcttgagtcggaggtacaggccgtaagcggcttctaccttcacggtcatgaaagggaaacgcctcagttcctatgccttatggatgtctttgaacagttgctgcacgccatgtatacggaatcttccggtatccattttccaggaggtacatcggatgaacctgcataagcttgaatatttagttgccatatctgaagaagggaacctttcccgggcagcagagaaactttacgtatcacagccggccctgagcaaagccctgtccgccctggaaagtgaactgggcatccgcctcatggaaaggcgttatgcaaaactgattcccaccccggaaggcaggatttatattgaagctgccaaaaagatgattgcggtcagaaatgaagtaaatgaaagcattgcccagatagctcagaataaagtctatccgcctgtccgggtaggtatcaacaattccactgccatcgctgaaatgatgttgtttatggtgaatcagatgcagatagaaatgccggttttctttgatgtggattctgttgaatgtacaaagatgctgcagaaagggcagctggatattgccagtttaagcctcccccatggtatccccgaggacctggattgtatcatgacggaaccggataccctggtgattgtcgtgccgaatacacctgaatttgactatattaacttacaatacacagacacaatccccatcacggcactgcacggcacaaaggcaatccaatgccgtcctgacagcgggcttggcataatggttgcccgttatctgtcagagaatggggtccaattcaactacgtgtgttccatcagcgtattaagcgccatcatgcttgccatagaaagcggggccggaatcgcgctgatgcacaggacacttgcaagggagagcaccgcctataagatctatacaccagatccccccatgtattatgaccattatctgtgtatacgcaagggagtggaactcacgcccaaaatcaggcgtgtcctgaaattgttatggggattggagctgtgaatctcagttcatgattcatgggacctatcatccctctaaacgtaaaaggaaccgcccatatcacactggtcagttccttttacgtttatattcacatgttgttacagggccttccctcatagtacaattccccggtcaccggatttttggaaaactttgtaaaatacccattccaaacagattcacattcacttggccaggttgcatgggctttggtgtccgtttccgtcagatgcagcattggcaccccatcctctgtctcaaacacatagtgcgctacaagtccgtctttatagctgcagttcttccccccatccatataggtgtaatccgcccacttcttagtcaggccatatctgccgcaccaatagtccaccagatcctgcgcctgtgtaaacccgcctttaaaagcagcgtcgcaacagcccaggttggctatgatgggaatcatggaaccttccacgggcggccgctccttccctccgtgttccactgcctcaatatcaatatgccttgcggaaaatggagccactgccgcaaaatagtccgggcggtaagcagcgcaggcccagctcatcattccgccagaggactgtccgctggcatagatacggctcttatcaaccggataatgccctgtcagccattggtacaggaagtccaggaacctcatatcctccggacgctccggctgcggctcccctgtattccacatggccctgaaaatgttgttggtccggataccgctgatggaacgcacctcattcggttcggatgcagttggcatgatgatcatgaaaccatacttatcagccacatagctccaaccgatacggtccgcaatctcatccccgcttcctccggcgccgtggaacacgaacacggccggcatcccgccctcctttggtgcggacttgggaacataaacataccactccctccggtaggtatcacgcctgtccccataatatccgccccacacatcggctgagaacttttcaaagcctctttcatatatattgcccgcccgcctcagggcgccattgttattgcccggatagcggtagatcccgtcaaacagctctgtcaggaccgcctcgctgtacttccggtccacgctcttttcccatggtccgaaatccgccaccacattggcacaccaatgttcatccacggtgccgccttcctgcgggacccaggtaatcctcatcccatccgcaccatcggatacaggattggatgaggcgccgaatccggcactggaaccagccccggatacaataccggaatccccgctgtgattcgcatgcctgtaatagccaatctcccgctctgccgcttcatcctttcctgcggataaaagccacacaggacactgcacctggctgtaacagacgccttccacacgggactgcgttgtcctcaaagcctctgcctcttctgctgtcatcccgctggttccaagcaaagccacggccgcgtaggccctgggcatcttcctgctctgcgcgcccaccgcatccgccgcgtccccataggcagccgcatagaaattggcctggaaggaacagaataaaggccgcaccgcaaggtcgttgttaagggcattgagataatccaggtcagccccgtcgtttttccagacgccaccgtccccggcttccatcagcaccagataaagcccataacggtctgaaagctccttccagccgctttccaccatgaactcccagggattccttcctcccggtataccgataaagaccgtgggctggttgtagatggaaccctcgggtatgtaaaattttgcggaacgggtcactgtcccgctgacagcgcagtcaaactggtaatacccatgaaggaactgcctgtaataattctttctgtctattgtcaccagggaagcgtccggtaaaacctgggccaccggttcctgtaaatatgatttcatggctgatacctcacctttctataattatatatattgcatgacaagccaaacacaccctgattctacgccggatataccgggaagaagatgctggctgaaataacaagggtcacaaccgcaatcagcagatagggcagcgtaaacttaagaagcttacccggctcatgctgtccaatggcaaacgccagggcacactctgctgagccgcttgggaaagcgatggccatgatggatgcaatattgatgatcagtacgattccccttggatccatacccgcgaccatggaaagcgatgcggcaatgggggtaaggacagccgctgtccctgtattagacataaaggtggtcatcacaatggaggtaactgcaaatacaaaaagcacgaacacgccggagggcttatccccaagaagcacaaggaggccatttccaatcatatcacccacaccggatctgccgatggcatccgacatcacaaggacgcccgcaatcatccacaccatgtccccggtcagggaattgaccgtttccttggtggtcagtgtctttgtgtaaagcagcacaagcacgccggcagccggaatcacatacatcagattgccaatccttgccccaaaaataaatcctaaaagaacaccgataaatacaatattgataattgtctcgtcacgccttgatatggccgtggtctcctttatctcctttacatcggaggtattgaccccatgccttggaatgaatttccatgcaaataaggcgtagatggtaagggctgttgcaggtatgaaggaaaccttaataaaatccccgggcagaagcatcagggccgggttacttatgatgccctcataatatgcattggccgtcggggacatggttgctcccagtcccacggggaatttaaggctccaggcagccatgacggcaaatgcagcaaaaatcatgcgcgaagcacagatttcatccttatcatccagggataccaggaacagggcgacaatggagacaatggccgtccttcccataagctgtgacagtacaatggttaccaggaatagaaagatgatgaacgcaagcccgctttttcccttaatcctctccatgctgttcctgaccttattgataaggcttgtcttaccaaaggcataggcaaccgtaaacatacaggcaatcagtatcgtggtcttgttagccagacctgaaaacgccgttgaaatatcaaacacacctgttaaagcaagcatcacgcagcaggtcatggtggtcacaccataagggaccttgtgtgtaaaaaacatggcaatcataaaaaccagcaaacctaaaacaatatacatctgcataaatgtacccctcatactttcctatcatttaagtaaaattcattaattacattcatactccagataacactaacctatcttccatcctctgccggcaattggatgtggttgtgccatccctgtaaatcttatgttttaagtatagtttaaatattccttattgacaaccatattaaattcatgttaactttaagtaaaagttatggaggtttgctatggacttgaaggaccagaaatacatggcggcgctggctggcgagggttcccttaccagggcggccagacgtcttaacctgtcacagccagccctttccaagtggctcggcgacctggagcaggaacttggcctgtcactggtcatacgctccaggcagggactgattttcacggaagccggacagatttacctggaagggtgcagggaatgtctggaagccgcccttgatataagaaggaagctggacgccctgtcccagaaggcaaaacagagcatcatcctgggtggaagccccatccggggcgcccaggcatttgccaagatatatccggatttccgccatcaatacccggatattgaccttcagtttgtaagcgataaaaacccggtgctgaaaaagctgctgctggagggcgagattaccatgtccctgctgggagccatggaaaccagcctgccaggccttgaatatcttaaattcatggatgaggagctgctgctcatgctccccaaaggccatcctctttcctacgattacaaagaacttccgccaggccgtccctatccggtcatcgacctggcaagcctgggtgacacccccatcctcggcagcgcccccgagacctcctacggcaatatggtcctctcgttttaccgcaatgcaggcctggaacccaatatcatattccgctccaacgtggtaccccttctctacgaaatggtgctcaacggcgtaggcgcggccatgattccggactcctattataatccggatgacggcatcagcgtgtattccctttcgccgcgcatcatcgtataccagggaatcggcctgcagagcggatatcccctttcagaggcggaggaatacctgatccatcttgtgatgaacaactggggttccccctattacatgcaccagtatgccgactattatcttgaacaaaggaaattaaggatagacgcctatgaatacaaccagatttgaataccttttggcattagaaagactcggcaccatgaccggggttgcgaaggcatatttcatctccccctccgccgtcagccagtgccttaaaagtgaagaagcccagctgggccatcagctgttcaaaagcgagaatcacaggatggtcccaaccgaggccgggcagatttatctgaacggcgccaggaaaatccttcagatacgggaagcaaccatggacaggcttaacgtcattcccaaaaagcaccattccatccggattgcagcggctcccatgctctatgaaaaaacagcttccatcatcatcccggcactgaacacattgcttcccggcactgattttgagctgctgcgggcagcttccatggtaagcgttgcttatctgctgaatgacctggctgattttgcactgctctgctccccacccttgaaccataccctgctttcagaagatatcctgggccaggaccagctgctgctggccgtccccaaggcatatctgcgcagccagctaaccgggccgccaaccatagaggattgcggtcccctgcccttcatccttttgaaaaacggttcctatacccgcggcattgaaaatgaaatccttgcacagcaccacattgccctgaaccggatatatgaagtggacgaccatgtgatggccaggaattttcttgaagaaggacggggcgccaccttcctgccatcctccatgattccaccccatgcagggcagcactttttcatccttcccctccatccgccaaaaccgtttaatttcatactggcctaccccaatttcaaaaaaccggacaaggataaaagggatgtgccaaggatagtaaaaaaggcgtggggaaagatggactttgatttttatgatccggtatgaaagcctgctttccattaccattggattctcactatcacagaaataatccgcacgattggatgtataaaatcaatccaaattggatgttgtcataccggcattttccatttacaatcacatcataaccaaccaatcggaggcaggcatgaacatccatattgataaatccaggaaaatccccctatacagacagatagcggaacagatacagtcacagattacctccggcgaaatcccccaggggttcaggttcccctcggaacggcagctggcggatgcccttggcgtcaaccggaccaccatactgaacgcctacaaggaattaaaggccgacggcctgatggattcccacgtgggaaggggaaccattgccgtcaggcccgagcgcagcaggccggagaagcccccttattccagggaacccatgtgggagtatctgttcagcgattatatgaagcatcatgatacgtttgatgtgaataaatatctggagatagccaaccagaaggacgtcatatcatttgccgccgggattgcatccgttgacaccattccggcgcaggcgtttgaaggaatcgagaacgaactgatggccagcagggagcggctgcttgtctcgcccgtgtcaggcttttactccctgcgcaaagcgataagctccttcatgcagaagcgctcctgtttctgccagccatcggaggtcatgatactgtccggctcccagcagggcattgaccttatcacaagggccttcatcaatcccggggacgtggtggtaatcgaagaaccctcattctttcctgccatccagagcttccgcctggccggggcgaaaatcatggccgtacccatggacggggaggggatggatgtgggaatacttgaacagctgctgtcccgttaccagcccaagcttatctacaccatgccggtcttccacaatccctgcggcatctcaatgagcatggacaggcgtatccgcctgctggaactggccggtcagtacggcatccccatattggaggatgacccctacagtgaactgagctatgaagcccgggccatgtccccattaaaatcaatggaccaaaacggacatgtcatctatctcagcaccttctccaagacaatatcaccgggactgaggctgggatggatgtgcgccagcaagaaactgatatcccagctatccggcatacgccagctcacagacctgcattccagctgcatttcccagcagattgtagagcgtttcatgaacagtggggaaatggagcatcacctcgccttcatccgcagggaatatcaggaacggcgcgacatcatgatagaggccctgaacagatacgcgcctcccggactgtcctggaaccggcccgaaggcggttattatctgtggtgcaggctgccggaaggcgtcacggcctctgaacttactgcaaaagcagcggcaggaggggttgccgtgctgcccggcgtgccggcctgtctgtccccccaaaagggcgagggccatatcaggcttaactacacctatcctccaaaggacaggattgcagacggtataggaatcctgtgcagccttatccgccagctcagtgccgcgcataaggatgaagaggcactgaccgccgagatcaatccaatcctttaaccaatccaatatcataaggagaatcatcatggactacaactacgcaagaaggatggcagatatgaaagcatccgaaatacgggaactgttaaagctgactgaaaaaccggaagtcatttcctttgccggagggcttccggccccggagctgtttcccatagaagagattaaaaaggcaaacaatcatgtcctggaccacaatggcggccaggcactgcagtattccaccacggagggatacggacccttaaggaaatggattgcacagcgcatgaacgcccagctgggcacctcattcggcggggacgatatcatgatgaccaatggttcccagcaggcccttgacctttcaggaaaactatttttagacgaaggggatgtggtactgtgtgaaagccctacctacctggctgcaatcagcgccttcaaggcatatgggtgcaggttcgtggaggttccaaccgatgaggagggaatgatgattccagaactggaacatgcattaaaggccgaaccggatgcaaagctgatttatgtaatccctaatttccagaatccaacgggaaggacatggagccttaaccgcaggcagaagctggctgaactttcagcagcatacaatgttgcggtaatcgaggacaatccatacggggaactgcggtatgaaggcagcttccttccctccataaaatcctttgaccgtaccggcaatatcatatgcaccgggacattttccaaaatcctctgccctggctaccgcatcggctggattgccggggaagcggaggtcatacgcaagtatgtccttgtcaaacagggcgtggacctgcagtgcagtaccattgcccagatggtcatttccgcctatctggaacaatatgatattgacgcgcatatcaggacaatacgcgaggtctacagaaagcgccgggatgtggcccttgacgccgtaaaccgctttttcccatccgatataaaatacacgaaaccggaaggcgggctttttctttggatagaattaaatgatgccgttgatacggttgcgctgcttgaaaagtgtcttgagtacaacgttgcattcgtacccggcaattccttctatcccaacagaaataaaccgaacaccctgaggattaatttctccaatatgccggaggacaggattgaggaagggattgcgcggataggacaggtactggttgtataagccagcctgtccaacggacatttaagacagtctgcagcttttaacccaacgggcttattatggcacattaaatttaaaagttctgtaaagttgtaaatagcattctaccgtatttctcttgactgtcctggagatttacgctatattcatttcaaggaacaatcgtgttgcagggtggcgttggccttcattctacatagaatggaggtgatgtctatgaaacatttcgattttaaagacctaatggcatttggaatgtttattttggcgttgctgacattcatttatttgatttgtcgctagcttaacatagaaaaaccacccctaaactttggcgagtagcagggtggaatttctatccaactattaggccaacccaccttgtgggcggttgttcctttttatgtctttactataacatttctcctcttaaaattcaagacatattttttatatgctttgttccatttgtaatttaaacttatctttaggtcagtttacaaggaactacacgcagaccgtgaaacgggctgctgacaacaaacggcggtatgctcccggaaagggcagcataccgcctgttttgttgtctggggtttccaaagggggtccccctttggcacacgactttgcaaagcaaagtgtagtgtgttatacgctctgtcggcgttgccgtgaaaataccgttgccgccggggagggcaagggcatttgaagcggcaggaaaacagggctgtgattgcgtggcgtggagccgcaagcgcaggactggtttcgccagcagacagggcgtatatgaatgcccccgtcccttgtcctacgccgaactatgggacaaagtgtcccatacagatagccacacttacgaaaaaacagacggatttttctctcaaaattgaaatgggcgggaagccattttagggctttcccgccttgattacccattagcaaagacgggcgggactgtcaacggcggcgcataaaatgcgccgttcatcttgaccgttgactggctcgactggctttgttattttcccggtaagtgagaatgagaataggtatgtatcatattattttatcataatcccatctggcaaaataatatcgccatcatctccactcacatcaaaaaatccaaccttgtgtttttgagctaaactacgcataagttcatacgcctcgtctgccaccgaccaagaaaacgcagcgtaaattacattatatccaatactgtaatcaaccatatgcaactccaaattttcatcttcatcaagagcatcgtcatttggtgcatattccccattcatgggcgggaatttttctttcatttccataaaccagttttgtaaagccggagaagaaacactaatcgtttggtaatcatgttcttcctcccattccgtttgcttttcataccatgccataaattctttttttgtggtaggtgcttttgttctctcaaaaaccatcaaatcataactcatattgataactcctttcagatttcttgtttatcgctctcttactttctccctcgctgggggtttggatttttcagcaagtccgacttctgtgcaatctttttcaaccatttcttttcttcctcggacagcttcttcaaattcaatttaagccgcttacagataaacgccaaagacgcttgttccgggtcgccgtcctcgctggcgacttcgtctgcggtctgtaaaaaatcttccagcggattgtcctccgggacgctgaaaaaatcgtccttatgtgctttccgcaggtcaagagctatcttgtttatgtcctgctgtatcacatagcggcaaaagctgtcatcgtcaatatgggcggcgataagctgtcttaactgcgggtcggacaagccgggattgtgctgcttcataatggttgcgctcatggcatccacaatggcgtttgcactctgcacctgtttgcctgctataccgtttacatagatttcaaggtcagccatcagccggggaaaatccgggtgtactgccagttcacacaagagggaattatccacccgcccgcttttcagcagttcaatcatatcatcactcaaacgcaggtctgcaagattggcgtttgggtgattttttgtttgagaacgccccagcagataatcggcggtcacgccgtaaaacttcgccagcttgataatagcatagtggctgatgtccttgaagtcctttgcttcatagctgcccagcgcagactttgagagatttacttgttcttcaagttgctccagcgtcagcccacgctccacacgcaggtctttcaatcgttcttgtatggataattccatgccctccctccttgtctacttaatatatgacgacttaacttcctaaacagtttataatttcttctatttccatacaagcatcctcaaccctgattgctgtttcctcgctaaagaagcggcttcctcccgctaattggtcaatcaagctaattaacacttcaacatcacaattcaaaataaatccctgtgttctccactttggcatttcaataaggatttgatttttaatttctaaatatttcgtttcgtcaaaagtattttcacatcttagttttaccagaaaactatcttctgcatttattaaatcacttaattttgacatagagacctccctaaacgaaaatggcattctgttttttccattttaccacaattccgagagcgtggaaatagagagttttccgggctgatttccgaccttatggatatacggggcgggcggtcttttaggtgtagacttagggtagttcatcgatgagctgcaccttgaaaaatgaatgaccgtccgaaaaggaataccccggcaggggaagcaccgcagcgagccacttcgggacaaaatgtcccgaagtccggggagcgtgccaacgccggaacacgccgcaggaatggggcaggaagccttttcggagagaacggcgaaggaaaaatggagggaacgcatgagagataacccctataaagacttgccgccgctggaacgcaggccggacggttccctttaccgcatgacaccggcgcagaggaaacgggcaaacgccctcattcgccgggagtgctgttgctgtgaggacggcaactgcattgtccttgacgatggggacacctgcacctgcccgcagacggtttctttctcggtctgctgtaagtggttccgctgggcggtcttgccgctggacgggacgctggaagcggatattttccgggataaggacacgaaacgctgcgctatatgcggacaagcctttctcccaaaatccaaccgggcaaaatactgccccggctgtgccgccagcgttcacaggcggcagaaaacagaaagtgaacagaaaaggaggtctgctgtggacagttaggagtgaaaaaagccttgatttatcaggctttgcaagccccaaaacggggcaggtggtataaaagtatcgtccacccccggaaatgccgttctaactgtccacaaagcacactatgacaaacacgatttatattcatcagccggagaaatcggtcagctttacccggctcccgaattttctctttgaagcccctacatttacgcccctgtccaacgaagcaaagatactgtacgcctttatcctgcgccggacagagctatcccgcaagaacggctgggcggacgaatacgggcgcattttcctgtattatccaatctgcgaggtggtcgccctgctccactgtgggcggcagaaagcagccaataccctgcgggagttgcagtatgcggggcttgtggagatacagaagcagggctgtggaaaacccaaccgtatttacccaaaatcctatgaagcggtttcaaacaccgacttcaagaaatcccgttttggtacgccggagggctgaaaagcgtacttgacaagtacgaaaatcaatcctcttgaagtacgaaaaccggacggaagatagaaatacagagattaacagatttatttatatcaattccattccaatcctatcagagctatttccggcgggattttcctgtggaaaagtcccggataggaaaagaatggggaaaggagtttatggcacagcacgcaattttgcggtttgagaagcataagggcaacccggcaagaccgctggaagcccatcacgaacggcagaaagagcaatacgccagcaaccccgacattgacaccagccggagcaaatacaatttccacatcatcaagccggagggcaggtactatcattttattcaaaaccgtatcgaacaggccggttgccgtacaaggaaagacagcacccggtttgtcgatacgctcattaccgccagcccggagtttttcaaggggaaatccccaaaggagatacaggcgtttttccagagggcggctgatttcttaatcgggcgggtagggaaagaaaatatcgtgtcggcggtggtacacatggacgagaaaacgccccacctgcatttgacctttgtgccgctgacaaaggacaaccgcctgtgtgctaaggaaatcatcggcaaccgggcgaatttgacaaagtggcaggacgattttcacgcttatatggtggagaaatatcccgacttggagcgtggggaaagcgccagcaagacaggcaggaagcatatccccacccgtctgttcaagcaggcggtcaatctctccaaacaggcaagagccattgaagccacgctgggcgatattaccccgttcaacgccggaaagaaaaaagaggaagccctctccatgctgaaaaagtggtttcctcagatggagaacttctccgggcagctaaaaaagtacaaagtcacaatccatgacctgttggcggaaaatgagaagctggaagcaagggcaagggccagcgaacagggcaagatgaaagatacgatggaacgagcaaagctgaaaagcgaactgcacgatatgcaaaggctgattgagcgtatcccgccggatatactggcggagctgaaacggcagcagcggcagcatggaaaggaaaggtgattttataagcagatttttacgccgtccctgtgcggcattgtaccttgaaaattgaatacaggaggttctatggagcatatcagatacaaaaaagaaacagaggtcgtgacttttcagggaaaagaaatcacgctggaaaatctctccccggtgttcacgccggaacaggaagtggccaaacgccgggagctggagcagcagctttatgaggtgttccgcaagtatgccgacaaacggcagagtgaggaagctggggcataaggttttccaaagccatcgttgatttgcggggctgctggcggtataataaaactgtcagcagctccgtttctttttgaagaaaaggagcgacaatatgaacaacagaatagacgcaatctatgcaagacaatcggtagacaaaaaggacagcatttccattgaaagccagattgagttttgcaaatacgaattgaaaggtgggaactgtaaggaatatacagacaaaggatacagcggcaagaacacagaccgtccgaagtttcaagaactggtgcgggacattaagcggggcttgatagcaaaggtcgttgtttacaaacttgaccgtatcagccgttccattctggactttgccaacatgatggagctgttccagcagtacaatgtggagtttgtgtcctctacggaaaagtttgatacctccaccccaatggggagagctatgctgaatatctgtatcgtgttcgcccagcttgagagggaaacgatacagaagcgggtgacggacgcttactattcccgcagccagcgaggtttcaagatgggtgggaaagccccttatggcttccatacagagccgattaagatggacggtatcaacacaaaaaagctggtggtaaatccagacgaagcggcaaatatccggctgatgtttgagatgtacgcccagcccacaacctcctacggggacattacccggtactttgccgaacagggaattttattcaacggcaaggaactaatacgccccacgctggcgcagatgttacgcaatcctgtctatgtgcaggcagaccttgatgtgtacgaatttttcaaaagtcaagggacaatcattgtcaatgacgctgccgactttacggggacaaacggctgttatctgtatcagggacgggatgtgaagcccagcaagaaaaacgacttgaaagaccaaatgctggtgctggctccccatgagggcattgtcccggcggatatatggctggcctgccgcaagaagctgatgaacaatatgaaaatccagtccgcccggaaagccacccacacatggctggcggggaaaatcaaatgcgggaactgtggatatgcacttatgagtatcttcaatccgtccggcaagcaatatctccgctgtacgaaacggctggacaataaaagctgtccgggctgcgggaaaatcatcacttcggaactggaaacggttatttatcagcagatggtaaagaaactggcaagctacaagacgctgacaggcagaaagaaagcggcaaaggcaaacccgaaaattgccgccctgcaagtggaacttctccatgtggacagcgagattgaaaagctggtggacagtctgacgggtgcaaacaatgtcctgctctcctatgtgaatgtgaagatagcggaactggacgggcgcaaacaggaacttgtgaagcagatagccgagttgacggtggaagccataagcccggaacaggtcagccaaatttccggctacctcgacacttgggagaatgtatcctttgacgacaagcggcgggtggtggacttgatgattaccaccatagccgctacaagcgacagtttgaacatcacatggaaaatctgacgggcggcacacctcccgtcagaccgttaccctgtgtagtcccttgtaaactgtactttcgtatgttctaaatcattagcaaaaaggccgccggtatgtaccagcggccttcattaaccatatcctctcccctatcacaccatatgcatatccgcataattcatatactggttccaatcatactcgtccatatcatggtccccggttttatggtgatgccccatactgccttcatgaagcgggttctccggcaggggcggctccgtcctgtccagtcctttaagaccgaacagcccatagacaggcgatgcctggaccagggattcaaactcagaagcaggatcggcccagctgtcattggtctttgttgacgtataaaccatcctgggcgccatcagcgctaccaggaaatgctggtcaaagggcatctcctcttcatggcccgcatacttctgataatttttcgcaaaccagaacgggaaacggtccagtatctgtccgatgctctctcctgtttttccccgggagattgcatccccgctgtttccggaacagctgctgacagccattgcaaaccgctcatcctgggccccgcaccacagggctgtcttacctcccctggaatggcctacaacggcagcccttttctcatcaatcagcggctctgtttcaaagtaatccattacccggcttgcagcccaggcccatacagtaatggtcccccatgcatcgtccgggcgggaatcctggtattccgggaacagcctgtgaaagccgatggaaaacccctcttcataatccggggccacctcctgggtcctgaacacggcgcatgcatagcctctggagatgatggtttcggccggatagaaggaactgtaaaactcccttgcggggtcacagttcatcgtgcccctgttgcagatttccacaaaagccggaaccggcttatccgcgttcacgggaataaacacctcgaaggtgaaaatgaaattccggttcccgcggaccgcctcaacctccacggtcttacggatggcccgtccgttcatgattttcccgccctgcctgacagcggccacgcgtatgttgatctgtacgtcacccatatcaggaagacgcccatactcttccctccttaaaatctccaagatttccggtctgcgtttccctgtccagtcctctgctgttttcacctctgttccgtcaagacaggtaaataatgaggggacattcctcttgttttctggtctatatatcatttgggattctcctttttcttatattcatttcattcattcccgccgtccgccctaaggaatccgccagaagtacccccttagggcatccggcggaaagccactttcaagcgcgccctagacttccgcttccgccgctgcctttgcattttcctgggctttatgcattgcgtgcagcaccagtgccacggcgatgacgccgtttgagataatggtacggaaatattcccccacctggctgtcattgaaaatcttcgtaccggcggccggagccagcagaaacagcagctggaacagcaccacgccgataaatgcctgttttacattggcccggtcaatggacgcgcctcccaccagcagtgcggcgatggagaaggttcccacattctgctgggccgtataagtactgaacgtacccatgttctgcaggaaggcaaactgcccccaggatgccaggaccgtggaaaatatggttgcaatgatacgtattctgttcacattgatgcctgcggactccgctatatggatatcgttcccgacgctcctgaaatcctgccccagcttcgtgttcatgacaaactggcacagcaggctcaccagcaggataaaaatcagggtgatgaccggaatactgcatctgcggataacggctgaggtcactggaatcaccagcagcgccgccagcaggattccaagacctgcccaccttacaatcctgcccctgcgccctgctttctgttcctcatcccctgctttccaaagccgatacccggtatagacagtgaatatggcaaacccgatgatgcacacagtggaaaggggcagcttatacgccgcatccagggcgcctttcatcccctcctgcaggttcagggtgtccttcacgccgatgcctgtgctgatactcagctggtcgtcccagaacgggatcacagtcccaagaagcaccaggaaaatcagcaggtatatgccctggccaaaatagcccgcaatcattccggtaatcatttcctggccccttgtccggttgaacagcctgcccagaagatagccgcagagcacggaaaccgctgtacacatcaccagcgccgccgcgattccggccacgcccgtaagccgccagtgcgtcacgaagataagggctgcctgtgcgctcatggctcccaccacgattccgaagttcagtcccatgccggtcaggatgggtatgataagggccaggaccatgatgctgttcctcatgacacggttaatcaggtcgctggcaaccacatagggattctgtcccgcaatggtatatgccgcaatacacagcatacaaaagaataaaaccacaatattttctgaaatccatttttttatctgattcatttttgcctcgagccctttcctaacgcgtacagaataataccattgctaataatcatccttacaatatccgagatattgctttccggcagaataacattggccaccggcagggacaatgtgagcagcccctggaatatcatgacgccaaacaatacgttaaaaatagacgcttttttattggaagcccctccgatcagtactgcggccactgcggaaaacgacatcattttcggcgaatcataaaactgcaggaatccaaagctctgggcatataccaggataccgataccgccaaggaccgtggacagggtaataccccatatcctcatcctgtcaacattgatgccgttcgcccgggcaagtccgggattctgtcccgcggcccgcatcatggtacctgtcttggaatgcatataaagatacatcaggaagcacatggcaaaaaggaacaggaacgtacccgtcggaatgaccaggtcccccagatggattggaaggaacccgtccaggatatccgcccagtattccgccaatgtaacatccttcctcacgccgcgtcccatctgcatcctgaggaccaggttgttaaggggaacgaacagccagacaatacacatgatggaaatcatggtaaaacccacataggtggcaataatcatctcagaacccttgacccggttcataagcagcccgtaaaggtatccaaacaccagggaaaacgggatggagcatatgattgcagccgcaaagccggcaagcccggtcagtttcaggttaaggctgataagaccgccgatgagtccgcagataatgccgatgggaagcgcaaagttcatgcctgccccgcataccatgataggcaccatggtaagtaccaggacgccgttcattgccatccgtgtaaatgcctgggaaaacagggttgccgtattcaggcccagcatcgggaccatggcagccaccacaaggaaaaaggttacagccacaatccttgtaaatccgaaatcttcgatatatttaatcattttgactttcattatcactgtacctccaatgcgtccaggccggacatcaaaaggccgaatgtctcatccgaatccgttggtttcaatacgcttttcacacggccgtcatagaccaccgcaatccggtcgcacagggaacgcagctccaccagctcgctggatgtaatgacaatggtgatacccttttcccggttcagggtcaggagataatccaggattaccttcttggcgcctatatcaatcccccgggtaggctcagacacaaacagcatatccggttcaaataccactgccttggcaatacagaccttctgctggttcccgccgcttaaatccgacgggtgctgctcgctgttcacgcacttaatccccagctccctgaccatgtcgtcagccgtacgtttcatggtcctccggtccagctggcggaagaatccataggatttgaaaaacctgtttttaatctgcatcgcaagcaggcagatattcatccggatgctttcatccataagcaggccgattccgctgcggtcctcggatacaaagccgattccgtccttaaggacttccagcggacggccaaagggaagtttcttccctttatatatgacttccccgaaggcggggtataaaccggctatcccgtttgcaatggcaagcttcccctgccctgccaggccgcagaacccaagtatctcacccttatgtatatcaatatcaacgcccttcacattctccccgggcatcttaacgctcagacctttaatctgcataatcgggccgtttttttcaatctcctccacgggcctgcctgcaatggctgaaaagtcaacattccttcccaccatcagctttgccagccccaccacatccacttccccttttccgatggtgtccaccagttccccgtccctgagcaccacaatcttatccgatatccccataacctcatccagcttatggctgatgaagattacggcaaccccggccgccgaaatctccctgatcgtatccaacagccaggtggattccatgtcggtcaggacggccgtcggctcatcaaacacgattaatttgatattcttcttgtcgatttccctggctatctccacaaactgcttatagcccacggacatgcttccaaccactgtggacgggtccaccttcagatggatcttatccagggcttcctttgtatccgacttcatgtgcctgcggtccagggtgctcatgctgttgcccactatgcggctgaccacattgggcttcgtattttcacggttcagctttacattctcggttactgtataggacggaagcagcatgaactcctgatgcaccattccaatgcccaggttcatggcctgtccaggcgatgccatctgtacgggctgtccttcccatatgatctgcccctcatatcccccggtattcacaatactggccatcccaaacaggatattcatcaacgtggactttccagccccgttctcccctaccagggaaacgatctcgcctttgcccacctgcaggctgacgcctttgagcaccttgttccgattgaattctttttcgatatttttcatttccagaattatattctgcattcttttctcctgacaaaccctgttcatgatataactgtgctgccatggcatgccgccagcggcagcatgcctgcaggccctatataagggcctgcctgttaccaattagaatatatacatatcccttgaaacagtgtaccagtttttatactcctcgcctgtctggtcattcacacagttctgatatgtgacgctgtccccataaatatccttcatcagcttctttacttcttccacgtcaggaaggccatccacctcgttcaccttgccgtcgcaatagtcaaccgcatactggaacaggaattcaagctcgcagcggatataggacttatcccagcccccaacccttccgttcatatcatactcacccagcttatcggaaatcagctttgtcacgtactctgcatcgtatttatgttcatcatccacctcgaggccaagggcgccggaaaatgcgctgaatggtgacgggtccgtatggcatggatagatgccgccgttttccacaaccgcctttaacatgctctcctgaatcgtgctgaccgttgcaaaataggcaacatccttggtatcgtactgctgcatcagggacggtatgttttccaaaaggaactgctgcgcgccgctgattcctgcatcaccggcaggatccggcatcgtaacctgctcaaacttgactccgtttgcctcgcatacttcctgcatggaatccctgtagcggaccttcatggaattgctcatatggcgggcaaagctgtagaaaacaaaaacctttgcgcctgtgtcaaccgccatctgtgcaactgccttcccgtataactccgggtcaatggtcagtaacaggtccccaaccttagccatctcatatacgtcttcattcagggaaccaaacaggaacttaatgtcagggcgctcttctttaatcttattcaccgttgcaatggtaccgatatccgcattatcaaatatcatcacctttacatccgggtccatggcaatatttaacgctttggagatcgtaacctcctgctcattctgcgggtcctcaggaaaaacatccatgatgaacttatccaatccatgcttttcaaccagcagttcagccgtcctgtaatattcctcacgggttgccaggggactgatcatcagtccgatcttataagttccggatgcatcctccggcgctgcctccgtctgttcctgtgcctctgccgccgtgtcctttgccgctgcaggggcagctggttctgggcttgaaccgcatgccgtcatacctgcaaccatagataccgcaagtgctgttgctaaaaattttttcaacatattcttctcctcctgatcattgtactatttccacaaccatacatgtatgtaagcaattacattctagcatatataccagacggctgtcaataaaatatcgacacgaatttatattttatttttatttatcaaaaaggggatttcagagtaagagcacgatatttttgtgtattttttatatattaacgtttttttatccaattatataaacaaattaatcaatttttactatggtttttatttttgtatctgttttgtaaatttgacatatcacttatattacaccacgattcccatatttatatactcgagtttataaaaatgccaacattcatctggcgcaaactttaaaactatgataaaataaattggaaaaatatccaggtactttcaatagttccaaacaggttagaaagcgagtatatccatgaggcaaaaggtcacacgtaatgatgtcgcgaaactggcaggagtttccccggcagttgtttcgtatgttattaatgattccaattatgtaagccaggaaaaacgggaggctgtcctgaaagctgtaaaagagcttgaatacacccccaatgtttttgctaaaagccttaggaccaaccgttccaaccagattgcactggttggggataccttacaggcagaattgtatgaagagctttcagctcagttattccaaaaggggtatttctcctgtctgttttacagccagaaggaggatactttcattaacagattgatagaaggacggttcgctgccatattcatggcaagcaatgcttttacggctgaacagctgaaccggattgtccagaacgggataccgctgatattatatcagagccgcgaatatataggccttgatccaaggattgtcatccgggctcctgatatttataatgatgtgaaacagatattgaattatttaatcatgaaagggcacacacggattgccttcgttgccccattaaaatacagggcaaccggggctgacggtgatgatttccgggcaagggcgtattccgaaacccttcaggccaatcacatcgaagtcaacccggatttcttttgcaggcacacgcagtcggaggcaagccttctggaggatgtggtttatatcatgacctcctacaatgccagccaacgcccaaccgcctttgttgccagcgatgaccatatggctgcccaggtcatgcagtgcatcaggaaactgaacctgcgcattcccgatgatattgccattgtgggttcaggcaatattgccagttcccagataacaaccccggagttaaccaccatcgacagcgggatcccggactttgcatccgaagttgcggatgcattattttgtatggccaacggtgagacgccggatgaccgtctgtacaaaggcaggctgatcatccgcggcagcacgtaagccccatggcggtccgcatcctaataatccattaagccctgcagcttatccacaacctcctccagctccgtaaccattggcatgcaattgccgccgctgcagagataaaacgctgccccttttccaggaagcggataatccctggtataaggggccagctctccaagtgcctgtgcattgtcttctgtttttacggtcaccgacaatcccggtgtagtctgccccagacagccgagcctggccagcagccgtgtccgctcttccccggcataagatggggacaggacacacaccagttcttttgtcggatacagcacatccatcatgaccagcagcccatagctgtggcccggtggatatccggccatggcgccggccagatagcgaagctgcttatccagtatctcctgccactgcacctctcctgtaatctgggccagctgctgaagtacacgtgcagccgcagaatttcctgacggcaccgccccgtcataggcttcctttgtccttacgatcagctgctccccgtcctctgcatacagatagaaaccgccgcgttcccggtcaaagaattgcaggaccatggttttcgcccagtaaaccgcctgttccagataaccagtcccaaatgtgacttcgtacagttccagcaacgccagcgcataacaggcatagtcatccagtttcccctggcccgcggcatccccgtcccggtagcgcaccagcagacgcccatccttcacaaggtgtgtcctgataaatgcctcagcccgtacagccatatccacatactgccctgcgcccagcactgccccggccattgcacatgcgcatatcatccatccgttccatgagaccaggatcttatcatccttgtggagatgcgccctgcggatacggtattcatataacttcctgcgggaggcttccttcccggcagtctcgtaatcctcatttcccagcagattcggtatattctttccttcaaagtttcctattccggtaatcccaaattgactgcagaagtccgccccatcttccgaccccagcacctgttttatttcctcaggcgtgaacacataatacctgccctccacgccatcgctgtccgcatcctgcccgcagtagaagcctcctgaagcatgggtcagttccgcttccacataaccaaggattctttgcaccacacgggcatacagcccccgcccggtaaggccgtatgcctttgcataggccatcgccagcagggcattgtcataaagcattttctcaaaatggggcaccagccactgttcatccgtggaatatctggaaaaaccgccgccaatgtggtcaaaaatccctcccctgtacatctgtaccagggtatccatcgccatgtccactgcccctggtttgttttcccttaccccgtattccatcaggaacataaggttgtggggcgtggggaacttaggcgcctggccaaagcctccattcattttatcgaaaccatccccaaagagcctgaaggcccggtgcactacttccaatcccggttctgccgacacatccgcctgttcctgttcctttaaaaaggcctctatccggcccgcaccctcaaggagccgttcccgtccccccttccactgcgccgacaccgctgccagcagttcctccagtcccaccctgccataccgcgctttgggcggaaaataggtcccggaaaaaaacggcctgcagtcaggcgtcatgatgatggtcagcggccacccgccctgcccgttcatggcctgacagaccgacatgtatacggaatccacatccggccgttcctcccggtccaccttaatacagatatagcccctgtttaaaatcccggcaatcccttcattttcaaaggactcccgttccatcacatggcaccagtgacatgtacttttcctgcggaccgtcagctatacccaatagataggaaaacaggcttatcctgcgaccttgctttctcaaatgcctcctccccccacggataccactgcaccggattatatgcgtgctgcagcaggtagggtgatttttcattgattaacctattgggttcattcttatgattgtccacgggaccacctcctttctcagaaaaaggatatgtctgcggctgcatacatatcctctttggcttatttgctattgattttcctcagttagcttccccggtttgtcccttaattattccctggcggatatgacccgccgtcctcctgcagtaaattcccgtaggtaatcccttccttcatgacaaagctacagtccagcagtgccttcatgtcagtcatcaggtctcgtttccagccagccaggtctgcatatttgcccggttcgacagtgccgatcctatcctccagccccaggatgcctgcatttgtcctggtggccgcctccagggcgtcaaagggagacatgccgctgttcatccaggcctcatattcatagccgctttcataattctgatgggttgccacaaaatcagttccgtatcccagacgtatcctgctgctgcagataacttctctgccagccctcagggcatccttataaagttccagctttttcctgaactccggctgtttatcctttattttctccgggtcataatggaccgcttcctcataaggggaaaatgtgggaaccagatagattcccttatcttccatcattgcagccgtctccctgtccatcaggcttccatgctccattccgtcaatcccaaaccggatcagcttctgcatcagttccctggtatatacatgggccgtcactgtcttccccagttcatgggccgtggtaatgatggcctccagctcttcatccttcaactgctgctgtacaggtgaatcatagggtgtgaagaatcctccggttgccatgattttaatgaaatccgtcccgtattttacctgttcccggaccgcattggcaaaaaatgctttgccgcttccaagcccgggcctctgcttctgcatgtatgcggaaagttccgggttgcgggcaaagccctggcttaaatccccatggctgccggcggtacacagaaacaccggcgctgccacgatccgcgcccccggcatgtacccacgctcaataaactcctttacatccaggacgccatagccattgctggtaatgccgcccacatggcggaccgttgtaaacccgcggcccagggccatcctggcacagcgggcaatggccagggtcttggcctcctcgctggtggtatagacttcttcccggattgtatgccagtcaatataatccatgtgcatatgggcgtctatcattcccggtgtcacctggcagtctgacagatcaatctccgccgcatcctccgggcggggaacctgcggacccactgctgcaatcaatgcaccatccaccaggattttccaattctgtttccattcccgtgtgactccatcatagagacgtccacacaggattattttacgctgttgtttcatccagacctccctgacccgcatccttaaattcaaactccggcggttcctccccaaggagatggcgtacgaaaaagtccagtttgcgccggatgaaatataaatccccgggcacattgtggttggcccttggaaggataagaaactcataatccttattgttctgtatcagacggtcgcagagtctcagggtctgggacatgcttacattgtcatccatggcgccgcaggccaggaaaagctttcctttcagattagatgccaggcggcttatgtcccccttcccatacagttcttcctcatatcgcccataataccgctccgtccaggaattttcatacatcctctggtcataattcccggcggacgccacaccggccttatatacatccggatattgcagcatggctgatacggtggcgtatccgcctcctgaattgccccagatgcccacccgcttcagatcaaggaaaggaaaacgttccttcagcgcaggaagacagcttacatggtccctgagtcctgcacattcatgaatccccttccagctgaaatcatggaacgcctttcctcttccgggtgttcccctgccgtccaatatgattcctgcaaaccccagctgggcaaattcctgcagccctcccatgacttccctgcccatggcattatcccaggtaaatccgcgcggtacattatatagctgggcgcctccgtagacataatcaatcaccggatactccttcccggcttcaaagcccgatggccgcacaagaataccataaagcagcgtaaccccgtcgtccgccaggaccgtgaaccgttccgggtaccggtatccattggccaggagtccggtcacatccgcccgctccagttccctgatcaatgtaccgtccaatgccctgattaccgtaaccggctcagcgtccaccctggaataggtgtccacgaaggtatgctcccccatgctgacctggtgtaccgcatcctccggggtaagccttttaaggtattttccgtcaaaggaaaccacgtaaagctgataataaagagggtctgagcattcaggcacatgattggccataaagtaaatctttttagagccttcgtctacctttaccagtttttgggcaatcagcgacctgtccgattcggggaataggtctccttcacagtcacctgtttccacattataacggtataaatgggcatatccgcttctttcgctctgccagaaggccagcttcctgtctgtagtaacaaaattggaaaattggtagctgccaaatccatccagctgcccaaaggcgcccaggtttaaaaatgtgtctgtcctttcccttacaataaggcgtgtcctgccgttccctgcctctgccagataaagccgtccctcctgatagccgcggccaaaccatgtaaaataaaagctgctgcaatccagccagcgcacaaaactcttttccccggatgtgaagaccggatccagatagggcggagcatccaccatgaccattttcttttccttgacatcgcccacgaaaagctggaaatgaggcagttcctcatcggaatccacggcaaaggggcatggatattccctaagccttggcctgacatcccaggccgaatctgaataggactctatcaaatacaggctctttaccttccggcggtctgcgcggtatgtgatgaaatagcggctgtccggactccacaccaccaggggatgctccacatatccctgcctttttaccgtaacctggctgtagatatccacatagcacccatatccgcacagtgcctcaccgtcactggtcagctgggtttccgccccgtccttttccctgaggtaaaggttgtgttccctggtaaacagtccgtatcttccgtccggggacatggtgaccggggacatgggaatcgtggacccggcggactgagggacaacagaaccgggcctaagggactgagggacagcagaaccgggcctaagggacctggacaccgttccatcctccctgcatatcttctcttcccccgtcaatgcgctgaccagcaccgtcacctcttccatcccatccccaactgtgctttccggcccatatccgtccccaccctgcacccacacctggcgggtataggtaaattcatccggccctgtccaccggatctgtggacagccgttaagcaccattttcctggtgttccagggcagcatcttttctgcggccctgtatttatcaattaaatccatcatctcattctcctaaggaatatttcacaagaaaaccgaagcgcctgggccaaggggcaggttaaagaccacccatactatcatctggattacccatacagccaggaatgcaatggaatatgggagcatcatggaaatcaggcttcccatgccaaagtccttgtcatactttttcgccatgccgattgcgattggtatataaggataaatcggggtgattgcattggtacaggaatcaccaatcctgtagattacctgggcgaatgcagggctatacccaagcatcatcatcatcggcaccaggataggggcaaatatgtaccacttggctgaaccgcttgtcatgaacagattgacaacgcagcacaacaggatgaagaacagcatcagtgggataccggtgaagcccgccgcccgaagggcatccgcgcttttaacagcaatgatcattcccagattcgtatagctgaacatattgatgaactgggcaatgacaaataccagcacaatgtatcctgtcatcccctccagggcctgggccatgaataaaggcacatcggaactgcttttcagggttccggccacaacaccgtaaacaacgccaaccaggataaaatagataatcaggatagggaccagtcccgcgattaaaggcccatttagaatagaaccatcctccgcccgcaggattcctccctgcggtatgaccatcagggcaaaggcaagaatgaaaaggatgctgaatatccccgctgcccgcagcgccttcccctgtctatccgtcaccttatcctcgcccgcactgtttcctgaaccgcgataggttcccagacgggggacgatgaactttttgttgacaaatactcccacagcagtcagtgtaaacacggatacaatcataaaataccagttacaggcagcattcaccgtcatggacgggtcaatgagcctggcagctgtctcggtaacaccgcagagcagcacatccgtgccggctacaatgatacaggccgtaaaacctgcgttagtagcagcataaccagccaaaagccctgccacaggatgcatccccactgattcaaacgcagccgcagccagagccgggacaacaatgatggaggcttctgaggcaatgctcccgttgatgcccaggaaaagcacggttgccgtaaggcaccagagaggcacccctaatatggcccggcgcatggcagtggtcagaagccccaccttttcagcaaagccaatggcaatctgcatggcaagtacaaggcccagcggtgagaaaccctggaaattggacagcaggttctctaagagccagataaacccgttcttgctgatcaggctgttggacaccaccacatcccctgtcgtagggttgattacactcactccggccaggctgcatgcccagctgaccatggccaggatcaggcacagccataaaaagagtatataaggatggggaagctgatttcccaccctctcaatgcaatccagcacctttcccccttttttctttcccaacgctttttcactcatatgcgctttcctccttcggtatcttcattttcttttttagaccgtggtcttattatagtaaaaaaataagaatggcgcaattgaattcttgccattcttaatttttctacagaatttccctgtttttttaatatttttgcctgctttactttctttatttaacataacccaggtaaaaacgctccaatttcggcatgctgacttccgtcaggccataacttccctttgacaggcaccaggaaatcagcaggctcctctcctcctcaatgatgtgcgtcacaatctgttcatgatccagggcatcggtcagctcccccttttcctgcccccggatcacgatagcggaaaaaatccttcttaccgctcgctcctccccccagaaggagattcccgttgttccggaaagctggcttatatacaggctggtcaaaagctccgcgccaatctcatcagacaggaatccgaacatataccggttgatctgtaatagctgctccatggtactggcttccctgtcaatcctgtcgtataattcgatgtatttctggtcaaagatctcatagagggagtccagaagctctgcctttgcatggaaataataataaaaacgtcctttggaacacctggcctccttcaatatatcccccatggtggtgttctggtaaccctttttataaaaaagccgccaggccgtgttcagaatcagctggcgctgtctgtgttcattttcctcatccttcgtcctcatggaaagccctcccaatctgccagaacataaccgcgcttgccgctgcaacatttaaggaatccacgccgtgggacatggggatacggaccgtgtaatcgcagtccgcaatggtttcttttgacagcccgtccccttctgtccccaggatgactgccagtttatcttccgccatcagccccgcatcgtcaatgcagatggaatcatcgccaagagccattgccgccgtcttgaaacccatcccgcgcagccggctgattcccggctggggccaggaacaccggctgtccaggatggtccacggaatctggaagacagtccccatgctcacccggatggcacgccggtacagcgggttgctgcaggcggccgtcagcaggacggcgtccatgcccagggcagctgcagagcggaaaacagcccctatattggtgggattcatcacattttccagcactgcaatccggcgggcgcccccgcagatatcctctaaacccggcagcggcgggcggtacatggcgcacagcatcccccgggtcaggtggaatccagtcagctgcgtaagcacgtgaaattcagcggtataaacaggtatctccccgcagcgctgtatgatatccctggcctgtgtccccacgtgcctggtttccatcagcagggatatggggacacatcccgcgtccagggcgcgctctatgaccttgggactttccgcgatgaaaatccctttttccggctcatggcggtttaaaagctgtccttccgtgagccgggcgtagatatccagttccggggcggaaaaatccgttatttcaatgatattcggcataaacctcctcctaatccataatctgtcagatatccgggcatatctgcgctaatccggccgtctatcccagaagtctacgcaccatccccgcgtcaaaggtaacagacgggacatggttgacctctatctggtaaagcgcattggcagccatgtgttccgccgcctgctccaaatcacggattcccgtggtgttggaatacttttcaatcaccgcgtcaacggcatccgggggcaccacacattcctgttcagccagccccatgcgcctgaggaccttgggcagtgaatagtttgagaatatgattttcttttcctccggcgtataatcagggatgtctatcactgcaaagcgggacatcaggggcgcgctgatctggctcttatcattggcagtggcaatggggtagacgcctccggtgggtatcatgcactcaatatagttgtcggtaaacccaagattgtccagaagggtcagcaggacatccgccggattgctgctgcccttgcccgaggacgccttatccagctcattgatgataaaaacaaggttggattcccctgccatggaaaatgcctccatgatgatgcccggctttgcattcgtatagatacgggaactgccggtgagctgttccgaatcattgatggaactcatatcaagggtcgtccacggaagcttcaggatacgggccaccgcataggcaatctgcgacttgccggttccggcaggccccaccagcagcataccgtacgcgggaagggtgtgggtacggttaatctgtatgatggtttcaatgatccgctgtttcacccgctccatgccgtaaagctcctcatccaggatacggcgggcctcctggggatcaatggactcaaaataattatttttccactggatgttcatcatgatggagagggcacgctgggcatggcgcctctcttccggggtgacttcatgggaacgtgcaacggcaaggttcctcctggcccagagccggatattgtcaggaagggtcctgccggcacagttcatgaaatccgatatgctctgcaggctggtcagcttcatattgtcgccgcccacctcctgctcttcctcttccagctcatccgccggggcgctgcttgccagcagcctgtctatcatgaactggaggaaaccatcctcggcagaaagtttggtcccgcccccaaaggccacttcgcgtatcttataaaccgcatacccatcttcccggttctggccggacagacgcacgctgatgtggttttcccccagccacttgagaaggctgatgaaacgggcgtcaacctgcaggatatccgccggaaatgtcccgtccttctcattgaattcaaaggccgtctgcctggcctggttggcaaacacaccgcaggaatgatgcttccatgcccgcctgctgttatccaggaccaccatgggcctttccggggttgcggttgtttcattggaacgtagcaccgtgtaggtgcatacgcactcctgtttcttatctggtgtatgattgaaatcaaataccggcattgtatgaatcctcccttgcttattacccatatattttaaagcttatccggcttcagacggaactgccctgtcagtgatttcaggaactgtgcctgggccgacagctcctcactggcagccgcgctttcttccgctgttgcggaattggtctgcaccacatcggatatctggtcaatccccttctcaatctggcggatggacagcgcctgctgcctggaggcggcggcaatccgtcccacgctctccgtcacaagccgtacgctatcaagtaccgtttcgagggaacgggcagtctcatccgctatatccgtaccggcccgtatgctgtccagggaagccatgatcagtgatgctgtattcttagatgcctctgacgatctgattgccaggttgcgtatttcctccgcgaccacggaaaatccttttccggcctcgcccgcccttgcagcttccacagccgcattcagcgccaggatattggtctggaacgctatgtcatcaattgtcttgatgattttaccgatttcacgggaactgctgcttatgtccgccatggctgccatcatgtcctgcatcctgcggttactttcttccgtctcatccccggctgcaccggccctctggcttgcctccccggcatgatccgcattctctttcacctggccggaaatactcatgatgtttgctgccagttcttcaatggatgccgcctgttccgccgccccctgcgaaaggagctgggcgccggatgacacctggctggcttcagatgccacctggtcggaagacaggttaatctgtgacagcgtattgctcaaagagtcttctatctgccttatggagtcaagcaccttgataaaatcaccctcatactgctccggtaccctgctctgtacggcaaaatccccttctgccatcctgcccaaaagatacccttcgtcgtgcaaaattgacttaagggtgccggatgccctgcgcatgctttcggccagggaacccagttcatccctggaggtatactggatagcggcggcattcaggttgccgtgggccagattctctgccgcctgctccagctcggcaaccggcacagtgatggatctggtaatataggtgctgaacataaggctggccaggacactgccaatgcccaggacacccaacatgaatatggcctttatctggctttggcgcaaaccggatatcagctcttcgccttttaaattgctgttttctatcagcaggtccagctctgcctgggcggcttttatggtggggatgttattggcctccatatatgcaacggcttccttattcctgttctggctggccagggacattactgtctccctcatgggcgccagccggtcaagctggtcctcaagccggtcaacaatctgctggtcactcttaaaatgctcccgcacaaagggaatctgattctctatttcctgggcagaggccttggcattttccattgcctcagatatgagggcttcatcctcattgacgatggtccggtatactgccttctgcatccgttcaaaattggaattgatgatattggcgctgcccttcacaaggaacgggccatcgtaaaacacctcaatctggcggcttaaacttaccaggttgatgatgctcacagcggttcctgcaacaagtaagataagcaataccgcatatgatataaccagtttttttccaagcttcatattcttcatccgtgacatctcctgctgccttataaaggccatactaatcagtctgttttccttaaaccatattaacaccgccctaagtatagcaaagcattggagaaatatcaaccgcaggaggaaatgacacataaaatcataaaaaataagcagggcaccctatcctgatgccctgcacagatgcttattaaatcctgtgaagccggtaaaatcttgtaaagctggtaaaatcacagaagtaaaaaccaagcctgtccgccgcttttccggtgtgattcacggtgcgatgatatactttcccttcgccctcagttcctgttcggacaggatgtctttaagcttatcaaggccgcatacttctgccaccatgctgctgacgtctatccttcctgagtcaatcaggtccagcgccctttgctgtgtgtatggattgatataggaggatttcagttccagttctttacggaatatctcaaagggttttaccgcaatctgctcatccggcccggtaaggccgaacatcatcacggttccttttggtcctgctatctctatggcctggctgatggtagacggccgtcccacacactcgatgacggcctggacccagcaaaggccattggccttcagggcggcctttacatcctcatggaccggatcaatgcacacatccgcccccagggcctttcccgtcatccgcttggattccaccggttccaccagggcaatcctggctgcgccggccagcctggccagctgcaccatcaaaagccctatcatgccgcccccgatcacgaccacctggtgtcccggctgaatcccacacatatcaatcccgtgcaggcagcatgccacaggttccgccatggctccctgctggaaggtggtgcgctcccccagaagatagacctggccctcatccaccgcgcagaactccgcaaagcccccatttacagttgtcccatatcctgtcatgtgttcacagaaatgggcatagccgttcctgcatggcccgcagcttttgcaatagcggttcgggtcaatgcacacccggtccccaggcttataacgccgggccagttccccggccctcaccacaatccccgaaaactcatggcccagtatggttggcggcgttacctctgccgcgcctttatccccttcatatatgtggacgtccgtgccgcagacaccgcatgcctttacctggatcatcacatcccccggacctgcttccggcattttggaatcctcaatcctcaaatcatgtttcccgtaaaataccgcacttttcatataatcagcctttcgtcctttctcatggtttccccatgattttccattattttccatcattccccatgattttcccctaatgaagctccggccagtattcccggtttgcctcaatcaggtcatccagtatcttctttgccacggccgcgctgggcacggtccttgacagggtcagagcctgccacagcttctgatagtttccttccatccacgcctccaccaccagcttctccacactgacctgctgttccatcatgcccttctgaaactgcggtatccttccctggctgattttctcatagccatccttgcccacgatgcagggaatctcaaccattgcttccgggtcaaagttctcaatcgccccttcattgggtacaatcagcagcattttttcctttgtgttaaaagccagcgcccttgccaggtccacgatataagaggcatggtcatccgccatgaacccgcatcccttggcgctgcctgtctcaatgatatccctggcagctgagaaaacctccttctcccttccctccatcacctggttggccctggtatggtgcggatccgtatgcgccaccacgtaatccgggtacaggtagtatttcagatatgtgttgggcagtgtatccggatcaaccgcgtacacatcccgtacctttagaaatgtctcatgccagctctggtccgcatgctggtcggtttcaatattgatgtcatatccattttcccttacatactccttaagccggggcatcaggtcattgccgtccttatccttcacctgggtccaccatccgaaatggttcagtccaaaatagctgatatccaggtccttttcactgattccaaggatttttgccatccttaccatgatcccaaggggcatgtcgcagatattgatgatcctggaacccggcctgagccttctggttgcttccgccacaatcgccgccggattggagtaattaagcatccatgcattggggctgtattgttccatataatccaggatttcaaggatcccgccaatggagcgcatcccgtaggcgatgcctcccggtccgcaggtttcctgtcccaccaccccgtactttaacgggatcttctcatccttttcccgcatggcatacttgcccacacggatatgggccatcacgaaatccgtacctgtaaatgcttcctccgggtccacggtataagagaactccatctgcggcgcccgctccttaagcaggattccgcaggcctgcccaatgactgcctggcgttccctgtcattgtcatagaggcacagcctccggatgggaaattcctcctgatggtccagcagcatcatgatgatgcctggtgtgaatgtacttcctccgcctgcaatggtaatcgaaaactgtctcatttcatccttcctttctgttgtctggctggcccggattttcctgctccggacaaagccgctttaactcttcctcactctttcccagacattcctcaaattcttcccttaccttcggcaccttaagccccacaatcacctgtaccgccgtgccgtttatgctcagtccatgggcgcctattcttttaaaatcatccgagggatgcaccagcttcccgtcctttacattgacccgcagtcttgtggcgcagttggtcacatcgatgatattgtcctttcccccaaggtaggaaaggatatgcgccgcataggataaggagccgctgtctgccagtttttccttataatccttcttggtatagagcctggcctgtgcatcctcctgttcacgtccgggtgtcaggaaattaaaccttttaatcaggaaactgaataccaggaaccatatcagcgaaaacacaagacctaccacaatctgtatcacatatgtatgccagtggttcctgccaagcggaatccagttcagggaaagccaggcaatcaggccgtttccaaatgcccctgacacccccgccatatacatggccgcattgatacaggcacataaaagtgcatggaccacaaagagcaccggagcaatgaagaggaatgtaaattcaatgggctccgtgattccggtcagcatggcggtcagggcagccggtaccatcagggccaggacctgtttcctcttttccttcttagccgttgtataaaaggcaagtgtgatgccaatcggcgcaaacaccttggcattgccgaacagctcaaaccctcctgccgggaacaactccttaaggggaagggtgctggctgcaaattcattcaggtgaagggcccagtacgcctcgattcctccaggcaccacagctgaatccagggtaaacggggcatagatgaaatgatgcaggcccgtgggcagaaggattttctcgcagaacgcgtaaagtcccaccccgatggtgccgctggccttgaagaatccctgaagcatcagcatggctgcctgtaccttgggccacagccctgcaaacaggaacgccatgggaagcatgataaaaaaaccgataatcacaacaaagctggaaccggaaaatatgccaagccactctggcagctccgtatcaaaatatttattatggataaacaccacaatacctgatatgattaacgccccaagcatcccggtgtccagggtctttatgccgcagatcatggtcaggccgctggtgcctccgatttccgccccaaagtccacaccgaacccggttccccagaagtccagcaccgcggaaaggaaatactggaatgtgacatagatgacaaatgcctccaggacacatctggcattctgtttcttagcaaggccgatgggaagcccgatgacaaacaataagggcatctgcctgaataccatccaggccccttcctgtatcatgtaccagagtttataccacatcccctcctgtgcggacaggcttccgaagattgactgattcatgaacaacgtggacaggcccaccatgattcctgcaaatgagaacagcagcacaggtgtgtacatggcgcctccaaaacgttgtattttctgcattacccctttcaatgtacatcctccttatctgaaattgatgttttcctgcaagacgtctttgcttttgtgacttcattttagcgcgtccctggcgccagttcaatagcccggggccatttaaggaacaggtacagctttaaatcttctgcacattttttgtacttacgcacacaaaaggtaacaaaaaatgctcaaaaccagctgtttccagcatatctttttgagcattctgccattcatatgaacatacaggttcacagttcttcctgtttccgtttcaggtacatcatgtatttcacacacataagctccaccacgttaaagtaagagctgcatgtctcaaaggcaacgcctcccttgttcaggaggaggttggggttgatataaaggttcctgtcacacagcctggatacctggttgtcgctcagccgtgtgatggatatggtgtaggtcccctttgacttcagcttcttggccgcggacacagccatctcagtctcccctgacagggaaatgattaccaccaggtcatgttcatccatatcctccagcgccatggtcagctcactcctgccgtatagggtcacaaaaaaccgtttgacattcatgaacatccgcttcatcatctgtaccgccgcatactgtgtctctcctgtgccaaatgcaaagagacgcctggcaaggaaaatatgctcacagatttcttccatatccgtatccctgatgctgctgatgcacttcatataattgccgcacacctcatccagcagtacgtccttttgcacctggtccgcgtcatattccagttttaaatggattttaaattcccggaatcccttaaaccccagcttttgtgtaaacctggatatggtggtcctggatatgcagcagatatcggccagttcctcaatggagatgtcgcagcattgttttttgtgggactgtatgtattgccagattaacaggtcattatcattcagtttattgtagttgctgtttaccagttcttccaggcgcatggggacctccctttggtgtgctgtgtatcatgtgttggtattattttagcagatggaaggggaaactgcaaatggatgcaaaaaaacaatattctccttgacaataccctaaaaccagggtatacttaagaagtattttttataagattctgatttcacatgtttttgtaagtcattattcctatgatggtttacaaaaatatgtgatttttttattttattgaaaatcaaaaataatattaggaggtatctttcatgaacaaaggtacagtaaaatggtttaactcacaaaagggatttggatttatcacgaacgcagaaaacggcgaggacatttttgtccacttctccggaattgctaccgatggttttaagtcattggatgacggacagtccgtaacattcgatataaccaatggcaaccgcggcttacaggctgtgaatgtctgtgcagcataattcttgatattagtcaggcaaagtttctgacggtcctgcatggtaggaaatacgcatgattgaacaatacccgttaactgtatgggcatcatatgtccagaaaggtggtaacttgtttgaaaagggagattttatattttatggagccgttggcgtttgccaggtagatggtatatcaaaacctgatttttcagataatgacaaactatactaccgcttaataccaaagtttgaacccaaccggtccatctgcatccccgtagacacgacgaaagtcctgatgcggtgtatcatgaccaggagggaggcgcagaatttcatactgtcctggcccaatgtccaatgcaaagggtatcggaatgataaggaacgccccctgatatacaagcagatcttccagtctggaagctgtacggaactggctgccatgattaaggaaatactgcagatggaacaatcccgcaaaagtaaagggaatgctttgaacatccgcgaacgggacggtgtcaaaaccgcccgcaaattactgtttggtgagctggctgccgcgctggatatcggtcctgacatggtaccggcctatatacacaatgtaaccggatgttcctgttaagcaggttccatggatttaggatattacaaccagatactatatcataagaggcggggagttttcccgcctcttaatgatttctctgctttctttctattgaatataggttatctttcgtctatactaagggtagacacggtgttgtatctgccggccccgcggcagaccatgaatcctaccaggtcaggaggtaccggcatgatggataaaattaaatctgtttttaattctgaaaaagggatgactgtcgtaaacctgcttttcctcttatctttgttaatccgcaacagcgggataatcttcattgcctgtacggcatggattgtgtacctggtttattccatcaggaatacctcatccatcgcggttaagattgccaatggaatcttcattgcccttgctattttcatgattgcggttaacctgtatttcatgttggaccattatggggcattttcccgttaatcggattccttatacctgaagtccatcataaaccccgcgtatacgcatagccagctgctccatatgctcatggtccgtcccgcagcagccacccagtaatttcagaccgtaattcctgtgcagctccatcatttcctccgcccactcatctgccgggctgctgtaaatgacggggctgttatccagttcttccgggctcatatccgagccattggcctccagacctaaaaagcgttcccggactaatttcgtgcggttcggctgtttgtccagggcggacatgacattcctcggatggacacagttcacctgataaaacatgggcggatggtccacggtcctggaatctatatagtcaatggcatcgttaagccatgtgccgtccatcagctttccgtccttccggattaaaaaggtaatgaagtacggaaccgaggtttcgctcagcgccctggcgcatccggccgcatccggcagacacggggtcaggccgttgcgcacatggtccacaatggatgcttcaagcattttggcatggtccgtatagaatacatacgccttctcttcctctaatccggtcagcggatcataagaatcgccggaaaatcccatggttgtaccgataaatatccggtcacggatggaaggatagccatcaacgattgaacggcagtgattcagattatctgccgatacatcccggtcttcccagtacgttccctttcccatggaaggggaagtcagtctggtataaggatgaaggatcattggcagatcatatctctgggcaatctgcacgtaatcatgaaacacggtatctaaaccgcggtgtccatcctctgtgtagtacagtccggccagtttcagtggcggcgccgggtcctggtgcgtaaaattacgtttaatccgctcccctatggatccctgcagcatcatgaccgggacctgtgcaaaggtattacggaatttttctctccgctgtattgtcgtcatgggcaatctctcctatgtgtatgtcttgcctgggaatcgtgcaataatcgtttcgatatatttatcctcgggttttgtagttccatatcatcctgtacagcagaccggcatcaatgggtttggacagatgttcatccattcctgcttcccggctcattttcctgtcttcatcataggcattggctgtcattgcaaagattggaacagaggatgcatccgggcggtccaggacgcggatgctcctggcagcttcaagaccgtccatgaccggcatccggatgtccatcagcaccacgtcataacttcctggccctgaagcacggaatagttccactgcctcgctgccgttccttgcacaatccaccacggctcccccggcttccagcagataaaccgcaatctccatattcagctcattgtcttcgcagagcaggacgcggaccccttctatggaaatatccttctcctccgccaaaaccggtgcgcaggcagcctcctgcaccacgtccatccagaaatccagggtgaactgcgttcccttatccggctcgctcttaacctggatggtgccgcccatcaatcccaccatggatttgacaatcgccaggcccagcccggagctgcggccgtcaaaatcagctgcgtcccggccttcgcgcgtaaatggctcatacatgtgttcctggaattccctgcccataccgatgccgttatcacggattaccagctgtatatgctgcttgccgtccgcctgttccagatcccgtaccgtcagttcaatgcggcctcctttgggcgtataccggaccgcgttattaaggaggttgaagataatctggttaaaacgcagcttgtccagcctgattctttcatacctcatgttttcctttttgaaaagaaactcaatatccttctgtctgcactgagggacgaccagggcttccacctgctgcctgaattcctcaacaccataaggctcaaggtgcaattcgatggcgttcctctcaatccttgatatatccaggatgtcattgagcaggcccatcaggaactggccggaggattcaagcttgtccagatagctttttgcagcctctgtctgttccaggttatctttggccatggctgccagcccgaggattgcattcatgggcgtccggatatcatggctcatcctggacaggaaatccgtctttgccttactggccttttcaagctctgacgaaatcagcttctgccgttccaatgcctccgttaactgcatctgcagttcatgctcttccgaaacatcggtataggttgcatagaacagcttatattccggcgtgcactccttaaggcataaatccgcgttcacccagacataggtgccgtccccccgaaggagccggtatcttttgaccgtgaaatggtctgtctcgtatcctgccctataggcgctgcgcacccgctccatgtcatccgggtggacgccggcaaatgcatcgccaaaatactggctttccagctccgcctcctcggcattgggcacgctggcattgaccgcagtccgctcaatacgcagcatgcggtattggcccagattcccgtaaacgggaagcagtctgtcatacgacggcatttttaatacaaccacacctgtggaaatacggtccaggatcccgttcgccgtttccgcattgagaccgtttacatgtccttcattcataacatccaatccatcactcatggaccaatcccctttctggctcatattgacttccccacctccgtgtctataggaaggcggattgtcatatcctgcggcatgcccttcatgcctcctgtcccatccacttttgcaggacttccaacagacgttcaatttctatgggctttgcaagatggtcgttcatccctgcgctgtgggcctttgatacgtctgatgtaaatgcattggctgtcagggcaatgatggggatggtccgtgcgtcttccctggccagctggccgttctccacggaatccacaagcatgtgatgcatccggagcagttcctccactatctcacggttaatatcattgtcctctgccaacagcaccttcataaaacccgtcccttctcagcttgctgttgttacagaacggacatggagaggtcctgttctgcaccacctcgtaacacttacggccaatcaccttcccgggctgtagctgcaaggtttcactggaagtcctgttaatgtaaagaagctcataggtctcaatatccgctatataagcatttccggaaaactcatccaatacccacttaaagtatcctgaagtctccctcagacgccggttttcctcttccagcttctggtatccgctgtcagctgctttgtaaaatgcccggcactccatatacccatcctgatccaaccctgcaaatgtaaccatcatccgcccccatgcggcatcgccttccctgaccgggaccgggactgtaagttccgcctcgggaagcttctgtaacgccgcctcattgagatggctctttatgtactcaaatccatccgggcaggacgtgtaatacgccctaaaatccgggaactgactgtgaaacccttccttggtgtatcctgcattccggcaaaacggaccgctcgcccaaaggatggtcaggttctcatcaagacaaaaacccactgcctctattcccatggcatcacagaccgtgacgtatccgtcccggggtatggctgtatcattctttgtaaccagcggctccggtttcctctgctccataatcgttctccttattcatccataacctcacacagcatcagcaggcctgggataaaacatacctacacataattgttttaagtataacaaaatgaacagggaatagcaacaatttgaattatccgggctaaattaaagcaccccctggccgatacccaaaccaggggatgtcatttaaactgacaggtttttgccgggccttacaggttcccggcatatatcttcatggccgcctcttcttcaaactgcctggaatacagttcatgataatatccctttttatccagcagttccatatggctgccccgctcaatgatcttcccgtcctttacaaccaatataaggtccgcctggcggattgtggataagcggtgtgcaatcacaaatgacgtatgtcccttcagcagatggtccgttgcatcctgaatcagcttttccgtctgtgtatcaatggaggaagtggcttcatccaggacaaagatggcgggattagctaaaaccgcccgagcaaaggaaatcagctgcttctccccagtggacagcaggcctccgctttcacccacatcgctgtcatatcccttttccatcttctggacaaccttgtccgcggacacattccgggcggcctcttcaatctcttcgtccgttgcatccagacggccgtatcttatgttctccctcacggttcctgaaaacagatggggattctgcagtacatagccaatctggctgtgaagccacagctgcgaccgttcccggtaatccacaccgtcaatcaatatccttcctttggtcggttcaaagaacctgcccaccaggttcacaagggtagacttcccagcccctgtctcgcccacaatggcaatgttcatgcccgcaggcacatgaaggttaaaatgctccaatacatattccttgccgtccggatacatgaaggagacatcctcaaacacaatatcccccttgattttctcccaattttccctgttgggtgaaaaggcatccccatacttttcaagcacatcgggccggtccaccacattgggcttctgctccagcaggtccatcaccctctcaatattcgcctggcaggaaatcaggtccgccagcagccttgcaagctgctggatgggttcaaatataaccaccgcgtaagagatgaagacagacagggttcccagttttatgagattctcctgcaccatatagccgccctttgccagcaccaccgccgaggccacggagctgaaaaacaggattgccgggatatataccgcgttcagtttcgccgaacggattgccgcctgatgcatatccgaggtcttttcaaagaaacgtttctcattgtccctttcaatgaccatgctctttgatgtcttgaccccggtaatcccctcgttgtaggcgcttgtgatctgggaattaatcctccttaccttccggttccacttaaggatccggttctggaaatacacggtcagcagggcaatgcatggaacaatcatggtaatgataagggccagccgcgcattcagtatgaacatgatgatgaacacgctgatgacatatataaaggcccagaacatatccaccagtccccacgctatcattccggcaatcctcaaggtgtcgctcatcaccctggcatggatataccccacaggggtcgtattataataggaaaatgataaggtctgcagatgctggaactgggccctttttaaatctttccccacattcatctcaatggatgttgccgcatggaccgacagatagacgcagacggtctgggatgcgatgaccaggatgtacaccagcgcgaatgcccaaagcccgtctaaacggtccggtatgatgaacgtgtcaatggcgtagctttggaacagaggcacaaggatatccacgcctgcaagcaggatattaagtcccagggtaaccgcaaaaaactttttatatggtttaaaaaatggaaacagcttcatccatatcctaaagctgaagggattattatattcctgttcttcgtatgctgccatctgtcatccctccatcttcgccctgtcatcacggctcatctgtatatcataaatcttgcggtagattccgtttcgttgtatcagttcttcgtgggtcccgcattcttctatcccgccctgattgagcaccataatctcatctgcacccatgagtgatgtgaccctgtgggatatgaggatgaccgttgcctccctcatatgttccttcagcgcgcggcggatgtcataatccgtctgggaatccactgctgacagggaatcatcaaatatcatgataggcgtcctccgaagcagcatccttgcaatggcaatcctctgcttctgccccccggacaaggtgaccccccgctccccaacaagcgtctcatatccgtccggaaatcccataatggcatcatcgatgcaggcaatccttgccgcatggcggatttcctccatggatgcatccggtaccgaagccgctatgttttcccggatggacctggaatacaggaatggctcctgcagtaccatcccaatgcttctcctaagctcctcgattgggatatcctggatattcctgctgccgatatggatactgcctccgtcatcccccagctcatacagccttgaaaggagctggattatggtagacttcccgctgcccgttccccctaataccccgaaggtcctgccctggggcactgtaaatgaaatgtcccggagtacctcctttccttcctcgtaaccaaacgtcacatgttgaaaggagatatcatacctgttgccggatgtatcagcttctttcccataggcttcttcctgggaacggatgatataatccacacgttcaaaggagacgcctgccttactcatatccgacaggatacgcccaagtccgcggatcggccacacaagggttgagttatacgctgcaaatgcaatgaattcgccaactgatatgacgccgttcacggcttccgccactccgaaaataatgaccgcaaccacctgcagtcccgttatcaggtcgccaatcccccaatacagccctgacagggtgcccaagcggatccacagcctggcaaatgcaatattcttctcatcgaaccgttccatctcaaattgttccctgccgaatgcccgcaccacccgcacccctgttgcattttcctgcaccacagtggacagttccccctccgcttcatccgcagtggtgaaccgttttgctatcaatttgtaaaacacggtggaatacacgatgaccaccggcacgaacagcaggacgatgcaggataacttcacgttcatggaaaacatcatgacaaaggacgtcagcacaagaaatgccgtgcgaaacacctccaaaagctgtgtcaccacaaagctgcggattacctccacatctgaggtgcaccgctggatgatatcccctgtctggttcctgtcatgccacttcatcggcagcttctgtacgtggataaatagcgtatcccttaagttcttcgcaaaattctcacctgctttggccgtgttggtacggcttacgtaggtgaatatccctgaagccaccgctacagccacaatcagcgatgccagttcccagaggttgcctgacagacgtcctcccccgttcccgcccagcacctcatcaatgctgaaccggaaaatctgaggtgtcagtgcatttaacacagtggatatcagcgatgcagccaccgctgccccgaaataaaccttggaaccctgaaggaacctgaatattaattggattttcctatatctggacttcgtatttttcttcatattgtttccatacccttttcccatacgaaaaaagagacgattgctcgccccttttttaggcttttccttaatggcgatgactcaccaatccgttacatgtagtatacatgatgcgccattcaaaatcaatagcttttgaagccttaatgcctgcccttgatgcctacatgacaggatataaaacaaatcctaataaatccgccacaatcagacacagcagggaacatatgacggtagaaacaaaaataaacttatagctatcctttgcagtaaacccgcaggtatccattatggtaataagcattccgttgtgggggaggcagctgaatcccgcagtggcaatggctgcaatacggtgcatgatttcaggctggattcccatggccaggtaagggccggataataaactcatggcaacatcggccccgcctcccccattacctgtcaggcttcctgcaaatgccgatgccacgcttaaggaaaccatggggtttaagggaagggctgcgatggcgtccaatatgaccttggcccctgaacaggcaaggaccgcgccgccgaagcccactgatacggccgtggtgaccatggcggacccaacctttttaatcccttcattcactgttcctaatttatccggaaggtttttgcggccgattaccatggccaggacagtccctgcaagcactgcataggaaaggtccattccgaatccattgatcaggacaataatgagtatcattggaagggcggataaccacggcctgacacctgcatccgcctggaagcgttcaatccgctcctgaatgtttttatccgcattaaaatgtccgccttttgcccttacccttgcgaatacggaccggaagtacaggaacaggaaacccattgccacaatggaacaggccattcccacaaccggggccgccattggcgatgtgcccagatacgtgaccgggatgatattattgagctgggccccgcccggcagcatggaaagcgggaatgtacaggaactgctcatgatacatgcaggaatcagttttctgggcaggtccgccttttggaaggttgccagaaaaatagggtatacggtaaagacgatgacgaatacgctgacccctccataggaaagcagcgccgttgccagcatggctccataaacagcattgcgttccccaaacgcctttcccaccattttggaaaatgacgctgccaaaagcgtttcctccatcaccctgccaaacaatgcatttgtgacaaataccataaaatacttggcaatgaagcccgacatggaaaccgcataatggtccatcatcagatccgtaaacgatatcccattggtaaatgccagtaccagaacgcagaccatggtagcaggtatcaggctgacccgcctgtatatcaaaataatcaataataaaatcgctataatcactccggctaaattcactgtaacaactccttctgggtgaacggcagcatcatggcgtttcacctaatcctatcagatttccatgacagtcaaattccatatcccgcggctctgattcaattatcaggcccttattttcctttgcctcctcatagaatgcctcggataaccatatccgccttatattcagggagttaggtatccttaccagcctccagtcatgggaatctgcattggtcacggtcttcaggcatacctggattgcctccctgtcgttttccatgacaacagggattcttgcgttttctatcatcttggtagtaataaggttcggatatgtctggtcaaaactcattttttcaaaaaagcggcgtgtggttgcatgggccattccaatcccgaccccgctatggcagctttcatcgctcaggtccaggaccgctacgcgctggctcctgattccgcctgatgcgtacggggtaaggaaggtgcctgttatgttagggtccataccgcttccgctgaaattcttgccaatctggtcaacaatcaggacatcgcactccggcacctgtatcctcggtatcagcgccttggccctgttaagcagttcaggctctctatcagcaatctcactgctgtccagcactgcgatttccgctgtctcatcatatgcattctcgataacggcaactgcaaaaaggatatttgaattccggatgacagccttgccaaaggcaggaacattctccgccatacgtccataaccctcatcatggcacacgcttgccccaatctgttttcccagtccaatggccatcattttcatgataccgctctcataaggccccctgaaattggtatgcggcttaacccggcagcatacaatgataccgtctgccccagccgcattcttatcaatcagtacgtcccttccatcctcagtacatcctattttcacaacatccatgccggattggatggggcagccaactgtctcctcggtaatcccaagggcacgcagtatggcgcgctgcccctcacccgtggcgcctccgtgactgcccatagccaccacaataaacggattggcgcctttgcttcttacaaatgcaacaatggatttcgttaagattacaatattttttatctgccgactgccacatgtgattgcaatattcatacccggctgtatacgggacgcaaatctgtcctgttcaagcatgccttctattaattctggtatctcctgcggttcaatatgctgattatcaaatacctgctgtaccttaaacattttagggattttgacatcttgaaccagatttgatattacatttcccataacccacctcccggctgcgttttagccggctttccttgtccgctgtccgcgtatatgcctgtaacgtcttttcaaaacacggccacaacgtaaatggatgcttaaaccgtcatattcacgctgtggcgttcttccaactattatttcatatatttcataccagctgccactgtaacaatatctgccttggcaatacaatcttcggtcggttcctgtcccagtcccggcagttccggaaccttatatgttccattttccggctgatagtcatatttgcaggtggaccggttcacgggattcagcgccctctgatgatgctcatgaatcaggaagttagggattgcagcttcaatctgcaaggcagcagccttggaaatcgggcttccgcatacatggatctgaacattggaatcatacagccacgccatatcgcatatcttttttgcttctgacagaccgccgcacaggcacagatccggctgcgccacatccaataaccgtttctcaaagaactgcctgaatccctgtcttgtataaatccgttcgccggaagcaatggggatgctggtctttttcttgatttccgtaaagttctccacattcagcgggtgggccggctcttcatagtagaatatccgaagaggctccaatacctgtgcaatctggatggctgccatggtatccgtattagaatgcatttctatgatgatatccaggtcttccccgccagcttcgcgcattgccgcaacacggtcatagactgtctttatgacatgattctggagcggtccgcgtatgttccatgattttccggatgagtcaggtacaatgatggggtctactttaacgcagtcatatccctcttccattgcccgcagggtcacatccgcatactcctcaggttccaccagttcctgcttggtgatatcagaaccccagttaaactgcacctggctggcatatgtacgcaggttgtcattggtcttacctcccagaagctgatagatgggaacccccaatgccttgcccttgatatcaagaagggctatgtcaatggcgctcatggccgcggaaacaacggttcctccgcccattccccagaatgtcttgcggaatatggtctcccagacctcttctgtattcatgggattcatcccaatgatctgctctgcaaaatcctgaatcattccgcggccggccctccagccttttccatacgcaaggcctgcctcaccccatccgcatatgccctcatccgtgttcacacggaccagcactggactccatgcgccccgtgtcgtggctcctttattaccgctaggcaactgtaatgcatcaatactcgtaatcttcataatcaattctccttttaagattcatcctgtttatccaggtttcaatgtttagcgctttccaggttcactttgccgctgttgtatctggccacggcatagattgcacaaaaaacaataaatacaacattaataagaagtatcttggtggtcagccccctggccgacagatacaccatgtaaaaattagctgcaaatgtaagtatcatgattgtataaaatacactgtctggtacatggaggaaggatttcttccattgttcaggcattaattttggcaggcgtatgattgataccgccgtgaccatacgcagggtatagcctactaataccagattattggtaatggtctttatgctcagccccgcaagcagggggatgattcccacaaggaaaatcaatgtcatgatgatgtatgggacatttcttttattcatctttgcaatggatgcaggaaaccagccatcccttgccgccctcaaaagcggattggcccgggaaccgtatgtggaattcattgttgtcataagagccatcaccggccctccaatgataaatacagggtacagattgccgaatatctcctttgccgccagggtcaatggtttccctgccacctcctctatgggaaggacaccgcagttagcaattgccaccgtcacatataaaatcaatatgacgcccgttgaaatcaggattgccagcggaatatccctggtggggtttttcgcatccttgctgaagttcattaccatatactggccgtatgtggaaaatgcgtaaatcgcaatcgcattcacaaaaccgccgtaaccttctgtaaaaaatcccggactgctgatatcgtacacagcagggttcaccattgtcattccatatatcccaaacatcagaagggcaatgaccaatatggctgaaaggatcttctgggcatttgccatcatattgacacccagcagattcagggcaaaaaagaaacagacagcgattaaaccaatgagcctcccattcatctcaggaaatatcgaattgacataactccccagcgatgttcccagcaaagacaggcttaggcattgtgatatgaatgccgtggcgtaaaaaccagccatcttctcattgagcatatcggctacaatactgtattccccgccctgaagcatggtcgtactgcttatgaagataaaaggtatgatactgatgaatccaaccactaccgctgctccgtaagccagccatgcagatgtcccagtggccacgatggctgttccgattaatgtgaccacgcctgctccgattacctgaccgcaggatatggcaaccaaatcaaccagccccaatttttttgtttctgtcaaaatagcaccccctcaaacttacacttttaaaatagtttccttcctccgtcatgtactttcagattttgtacgatatcgactgtgcgcactggaatcatacagatattctgtacaattgactaatattatgttacaatatctccatactttagtgaattactttcttttttaagagttgttagacttaagactaacgtacaggtgccgcctggctgcacatatgccacttcactccttctcataagattttcagaggtcctatcatggaattattacagttacgttatttcgcagagctggctaatatggagcatttatctaagactgcagagaagttgatgatatcaccgccctccctgagcagcacaatcaaaaaactagaaaatgaactgggtacccagctttttgacagaagcaggcagcagatgcgccttaacgaaaatggaaggattttttaccgctatgtacagactgcactaaataccctggattgcggtgtacttaccctgacacagaccaactgtcccatactcaaagtggccctgaccagttttcctgtgtggattgatatgatttatgcctatgagcagtcacatcccgaggtggttcttgagtacacggtcatcacgttagacgagctgaacaacgccccatcgccgtttccctggaacttcttcctgggaatcattgaagatgtggacacggggcgtttccagtcccataaggtctttccacctgaaaggcctgttgttttaatgtccgtccttaatcccctggctggccgctctgaaatccggctggaggaactgaaggatgagaatttcatatccgtaagaagggaaaattcctctgcccataatttcatgatggcactgtgccgccaggctggtttcgagccgagaaaagtctattatggggactacctgatgcgtgtaaagctggttcagcaaaaccgtggtgtcaacatcaccacaatggtaggggccaccgtgaatgcaattcccctggataccattaccgccatccctttgtcatcccccatcatgacccgcacgcaggccataagctgggagcaggataaactgttatcagatacggaacagacgttcctggattttgcggttagatactttaaggaacatccccttatggatccaaagaaactttgatgatactgccggatacataaataaacagcccttatggaatacatggccaataagggctgttttttaataatatcaaataaaatatctggtatggcataactatcatgaatcataaaatcagcaaaatattataataaatcgtcatcaaagcacaaaataccaatgataacggtaatgtcttacggattaaatcccccaatgtcacatgaaaataatcggatgcgaccaccagacacacatgggtgggtgacagctggctggccgcatgggtaatgcacatgagataaaccatcaggggcattcctcccggaatagcagcaaatgccaacggtgtacctaaggctatggcgcctgtagaaccgctgattaccgtggcaacaaaaaacagtagcgcgaaaattaaatatgtaggaagtggcaggattgccatggtttccggcagcaggttaagaacacctgtgtaagatatgaactccttcagcacaagtaccagaaacgtattgaccaacatggtcttttcaaaggcagattgaagcatgagcttcagttctgctgtctttataccatataccaatatggaaaccataatggatatcagaacagatgacaccacatctagcccaaatgccaaaatcagcaccaaaatcaacaataatgaccacaaatgctgcaacagatgctgcaaatccctgatacgtgacttacttggcattgttcctgtcgcttttggtatccgcctcagatacattacgtatcctaaaagcgccagtgtgataaccggtacaatcattcccaccatgaattgtgatattcccacccctgacagactcagcattaccagcactgcggtataggtcggaagcacactttccggaatatggcggaaccagcttgccaccaaagcctgttcttttggttccagatatccgtccgtggcatcttttacaatctcactgcacagaatcatggatgcagctgacgggagcagtccgataaacagcgatgctcctgctgtattcacacgatggttatggaaaatcccattcaaatcctcctgcgccagcttaatctgactgcgtgattccaaaatccgctgtaaaaatgttatcaggtacagggacaataatacagacagggacgaccattttgtaatgaccatggagaaacatcctgccattatcatgggcggaatccggtacagcaaagccgttgcgcagagtccgccgagaattgcctgatgcaatggacgccggacggccaacaagcctatgatgatgagaaatactgctaccagatacataatctgcattttatcgaaccccctgagtatataaaactattttatcaataatactttattttaaatgattctatttcagcagacaacttatctgcaaatttatgagtaactattatttttaataggagtacagatatttcatggtttcttcccacaatcggcgaaaactacgacagtcccatcaactgccgtagttttatatccctcaattaagatagattacccgcctctgccacaatacgttcaaccgcctgctttatataaaccggatcggtggcaaggttcaggcggatgaatcctttatatgcctggccgaaccattcaccgtaatccacagccagcctgcaatgcttctggacgaaatccaaggtctgttccgaatccacataacttcgtaaatcaatcattaccagatatgttccttccagcgcgcacaccgtcatcctgggaagccgtttattcagttcctccttaagataccggtagttgtcccgtatgacatccagtacctgtccaagccattccccgccatatgtgtaaccggcttttgtcgcaaccatacccatgatgctgacctccgtacggttcagggccgacgcaaactgatcgtattttccccgtagtccgtcatcggtaatgataatatgggagtgaaggagcgtggccaggttaaatgtcttggaagcggaattgagggtaatcacaatatccctgtacctgcctcctgatacgaccgcagccgggacaaaaggcttgtcccctaatataatatcctgatggatttcatcactgataacaaggacatcatgcttttggcagacagccaaaaccctgtcaagctcatcctctgtccataccctgcccgccggattatggggagaacactggatgaacatttttacctggttctccacgatggctttttctattgcttcgtaattcatggtgaaatacccatcgttataatcaagttccaccttgaccagctttctgcccccgtttgtaaccacattgtggaaaggatagtataccggcgtcagaatcaggcaggaatcccccggcttggtaaacgcatgaatcatccatgcaattgccgtcacgcatcccgttgagaaacgtacccactcctttttgacaggaaaatgataccggcgctccatccatcctgaaaatacctcatagtaatcatccggaacacagctatatccaaacaccccatgccgcgtccgttttgtcatcgcatccacaataccgtcacaggtcttaaattccatatccgccacccacatggcaagtaaatccgtttccccgaatttctgctgcagtccatcccattttaaactgtccgttttgtggcggtccaccagatatgactgcaaaaactcctgtttgtccaaattgtctttcctcctcctgatttaaaatccactttctttctcttcctttgtcctcagcaaaccgaattgtattgtaatacaggtaaataaaatcaataaaacaggataaaaagcgtatctcacgatttcaagataggttgcacctccgtattgctgtaccagaaggacactgctgtcatgaggaaccagcatcaggattgcgcaggagaagatatccaaaagactagccagccgtttcggcgcaatcttatacttagagcccacctcttttgcaaccggggccgtaatgatgatggctaccggattattaagcgtggtcccggatatggccatacttaccaaggatatcagatattcacagcctttcctgcccttgattttctctgtcatcgtcttaaccagccaggagatacccccatagtatttaatcaattcaatcaggccggataccagcatggaaaatactgcaaggaaaaacatttcttccatgccggaaccgatggccattgtccactcaaaaaaggtaatggtccccatggccattcctatgattcccgacataaggattcctataagaaggacaagaagtacatccaaaccggcaattgcagtgacaaggaccgttatgtaaggcaatacttcaagcacgctgtaatgaagcccttccgtatcaatcggaccgcttccattggaacccaggactgcgtaaaggataattgtaatcaccgctgccggcaatgcaatcaggaagttcatcttaaacttatccttcatctctgcccctacccctttggtggcgcagatcgtggtatctgaaatcatggacaggttatcaccgaaatatgcgcctgcaatcactgatgcacctgccattgccacattcagaccggctccctgggcaacagcaaccgccaccggtatcatggcaacctgtgttcccatggatgtgccgatacaggtggaaataaaacaggtcacgatgaatatacccggtatcaggaaatgggacgggattaaggtaaggcccatattcacaatggactcctttcctcccatagcggctgcggcggaggaaaatcctcctgccatcagcacgatgatcccaagcagcataaccccggaatttccagctccttgacaataaatatctatttttttacttataggcgttttcctgtcataaaatatcattgcgattatgattgcagccatgacagccacataacgcggcatttttccaaagggattttccacccccatgatggtaaataccaccccgcatccaacatatagtcctaaaaatatcagcattggcaaaaatgccagcgccttgtaattcttaccgcacctctcatccatgtatgtgtaccccctattttattaaccccggccaatatgtgccggttggaatcaatcacagcgtatgttttgtattcacagcctcgcagatacgtctcagtccctctgccagcgtggcctttgggcatgccaggttcaagcggatgaaaccatctgaattctgcacaaacatgttcccgccctctaacaggacccctgccttgtaggcaaagaacattggaaggtcctcatccggagcaaaatagtcatttaaatccacccaggccagataggttgcctccgaaacacggtattttgcccttggaagatgttctgccagatactccccgaccaagcggaagttgtcatccagataagcccttagttcctccagccatggctctcccttctcatatgcagcctgtgccgcggcaacactcagcggattatcaaaattatagtggcggccaagccaggtattccttaagtccccgtcacggatcatgacattagaaatcatcattccggccaggttaaacgtcttgctgggtgccatgcatgtaatcagacgcccgtaatcaggcattaccttgcccatggggatatgttcctgattcctgcggagcagatcgcaatgtatctcgtcggaaatcacccacatctggttcttctcaatgatgtccgccatcttccttaactcttcctccgtccagacacggccgctgggattatgaggattgcagagaatgaacagcgtggttttcccatccgcggcctttttggcaaaatcctcaaaatcaatgctgtaacgcccctcatcattcttcaaatcagaacacacgtattcacgcttgttaaaatctgccgcatatttgaaatatgcataagacggggtcatgaacagcaccttctcgtccggctggcagatatactccaccagttcatacagcgccggtatgattccatttgacatcaccagttccttccggtcaaaggtccagccataacgccgcatgcaccagtccgccagagcgtcataataacttttttcaaacaccctggtgtacccgaaaatacgtttatccagacgttccctcatcccgtcaatgactacatccggagtggcaaactccatatcggccacccacatacggataaattcctcatccttatatggaaacgtcatggtctcatccgcatgaaaaatatagtcccggaatccatccgtattcatggcatttgtatgccttctgtcaataatttcattaaaattatacataatttacattcctttccattgcagctgctttttgataagttaattttaacaactaaatgctttcaggtcaaagcaaccattttttctttacagtggaatttttatacattttttctactcaggatggaattttatagttctatatgatagaattatggataacatcgaaaaaaaagaaaaaattcgaaataatgttgatttgtacgatactttcaggaggtaaatgagtatgtcagaagtcagcgcacagattgggaaccagatacgcctgatacgcaaaaaaaggaaaatgactttggatgatttgtcaaatgcaatccataaaagcaagtccactatttcaaaatatgaaaaaggtgagattgccgtggatatcgaaaccctctatgaaatcgcggatgccattcaggtccatgtggaacagctgctgtattgttccccaaaacgcactgccatatcttcaaagaacagcagtcctgcattttttaatggggtatcacaaatctactcctatctatacgatggcagaagcaaccatattgtcggctgtgtatttgatgtcctgtcagaaacagaggaagggcaatacaagatcatgatgtatatgaacttcaaagatttcaagaattatcagaactgtgaaaatacatattggggctatattgagcactacgatgccatgacgtatatttcactgaccaaccaggatacgccgatggaaaaagccagcgtccagatactggcatcctatctggattcagacactaaatggggcttattcaatggcttttcttcccgccccatgatgccgattgccatcaagatgctgttctcaaaaaaccggttgaaggaggatgctgatttagtccggctgttgaaggtctccaaagacgatatccggctgctgaagctttataacatgctttccgtcacttgattttaccagtcacttcatccctgcatggtagtcacatttctggcattgggatagtgtattttcactgccctcccgatgataggccccggaccagaggcagatgctcttcaatatggggacgactgaactccccttctctgtcaggcagtattcaacacgcggcggaatttcgtcatactgcctgcgcagtacaataccatcttctatcatttcctttaaagcagctgcaaggaccgcatccgtaatatccgtcatctccctgcgaagttccgtgtaccgcagcacattcttctctgccagcacacagatgatacgtgatttccattttcctccgaaaatatcaagcccatattctaaagggcaccggatatctttttttaactttggtttatacattttccaacccccactctcaattctatttataatatgaatatctttttccattatagaagaagcactgtacatctgcaagttactatgtaatttattagtcacttattaatttaccgatatattcacattttcattttcgccttctataatcatattacaacttaaaacaattgatatctgaataacaggaggtcaacaaaatgaagatcaatgcttatcttgaaatcaccatgaaaatcgatgacacgaaccgccccgcagccgctaaagtgtacacagattaccgtacaccgtttctcaatacaatcccgggcgccctcagcaaagatttgttaatccgccacgatgatgtacaggtactgcacggattcgacagcgtggaacatgcgcaggcttatctgaccagtgaaatgttccagaacgatgtgtttgtcggtctgaaaccgctttggagcgctgaacccgaggtaaggatttacactgttgcataatatagcaataaaagaacccagcgaaaagcaattccggctttacctgggttctttaatatatacgtactttttctatttttccaaatctatcttataatcaatcacatctgtatatgcccttttacaggcgtcaaaatcatggttcctgattgccatacaaatgacacggtgtaaatcgctccatggttcgcccttctttttccgcttcttccaatattcaagacgctcctgcaggacaatatggatatattggttcagtaactcctggaacatcaggaatgcatagacaaataggtcattatgggaagcctcgcagatcttcttgtggaaatccgtatctgcttttactatctccttaaatgtatcttccgatggctgctctaagtaatcccgttttaaattttcaaatttttcgcaggcatcctccaatatccttatatcctgctccgtggcatgaatgaccgccagtctggaagcctcaatctcaatggcataccggaattcgcagaccttatcaagcagctccggccccagatagaattcgctggccctttcaagataacttccaaatgaaaattcttttacgtacgtaccatccccgacccgtgtctctaatagccccatcccaatcagcctctgcatggcagtccgtaccgtcagacggtttacatcaaacatggaggaaagttcaatttcagacggaattttttctccggccttccacctgccgttcttgatggcctccttcatgttctcaaaaacctgttcatttacaggcatcctctttactttcataccctcttcaaaagcactcatatcatcacttcccaattttctctattttaaatggattaatccagctataaggattataccgttttttcctataactggcaaggcattccacggcttttacaaaaagcgcggaaagcactaaggctttctgcgctttcatgtcattattttacttctaccttatcacaatgggtcagggcgtattctgataattcatttccaagtccgggcagggagggaatcccatattctccattaaccggctggtaatcataaatacacaagtccttattaaatttctgcagattatatacatgatgctcatgaatcacaaagttggggatacatgcttccacatggagggctgctgccgtacataaggggctggcgcaggtatgtacctggactccaatatcatacgtatgggccatgtcacaaatcttcttgatttccgtgatacctccgcaggtaccgatatccggctggatcatctggattgtctggtcctcaaaatatggcgcatactgccatctcgtgtaaatcctttcgccgctggcaaccggtatattgattctgtccgcaatgaaccgggctgtcttgggtgtcggtgtattcggctcttcgtagcagaatatgttatactgctccacccttctggcaatctgcaccgctgactgcgcatccaggaaggaatggttttccatgatgatgtcaacattcggaccaattgcctcacgcactgccttcacacgttcttcaaccaaatccatatattccggttttaataaacctgtacgctgttcctctgaaaaggtctttcctgccctgtcgaatgtgaagaagtctatttttaccgcgtcatatccttcctctactgcttttaaggcattatcagcgtaatcctgcgcacttaaagccggattcagggaatccccccagccgaattgcagctggcttgcataggtacgcagtttatcgcggaacttgccgccaagcaggacatggaggggaacattaagcgcctttcctttaatatcccacaaggccatgtccaatgcggataaccctgcaaagaataccggtccgccgttctgtccccagaatgtctgcttgtagattttctcccagatgggttctgttttcatggggtcggcccctatgatcataccggccagttcctttaccataccaaaagcgcccggagcagcagagccgtatgccatagccgcttcgccatccccatagattccctcatctgtgtaaatccggcagacaaccggtctccacgcaatattattccaatctgccggtgctcctggttctacctccttcatctccttactggaatgtaacagcattacgtcaatctttgtaatcttcattttaatttcctccttatcatccaccaaataacctgagcggcaggtaaatcaccgccggtacaaacgctacaacaaataaaacaatggccagtccaatcacgaatgggatcatcggcttgactatccgttccatgggtatccccgtcatggaagaggacacaaacaggttggtggccaagggcggtgtacaaaaggcaatggataaagccaacaccatgatgataccgaactgtatggggtcaattccatagggctgaagcacatttaataaaatgggtcctaagataacaatcataggcgtggtctggacaaacattcccgctatgaacagaatcaggaataccaataggatgacaaccaccttgctgtctaccgtgttggtaaaaaatctcgtaatggagcgggttacacccatataggcaaatatctgccccagggcggcggcaggcgccagggtaagcaaggtcccgccaacaaaggtgctggtcgatttcagctggttgaaaatctccttcagtttcagttccttataataaaagcagccaaccaccacaccgaacacacaggcaacgacggatgcctccgttactgtaaaaatcccgccatagataccgcccagtataataaccggcatgaaaagcgcaggccagccgtccttcatggaaaacagcagttcttttacagtgaatttcctctttcctacaatatggtgcttcttacaatagaagtagttgattaacataagaataagcccaaccaacagggacggtcctaatcctgccatgaataaatcgccaatggaaacccccattgtcaccccgtacaccaccatgggaaagctgggcggcacaataacgcccaatgagccggcaactgtaataagcgcaactgcatagtacttgttatatccatggcggaccatctccggaagcatgatcccgccgatagccgccactgtcgcaggagcagaaccggataccgccccaaagaacatacatgcaagaatcgctaccatgcccaggcttcctgtaatcctgccaatcagactgttggcaatggccaccagacgttttgacaggccgccggcattcatcaggtttccagccagtatgaagaaaggaagcgctatcatggtatagctggcgactcctgtatacataatggacgctatgaattcctgtgtcgtaattccgttcatcgcaatcagcaggaagatgggaagcaacaggcagacgccgattggtacaccgatgaaaaacattgcaaacatcacaatgaacatagttgtcaattccatactataattcccccctttctttggcttccagcgcctctttctcacaggaatccaggtcaattgcaggcttggaatatcccagattggtttcattttcattccataaacgtatgatatcctgtatgatgcggataccggtaaggattaaaaggattggtatccacaaatatatgattttcttaggtatcctgagcaatgaagtctcactgtcccccagggcctcaattaccttatacaaaggtctttgtatgtaaatacagaaaaacaggaatatgatctggctggttatcattaatgccttttttatcttgtatggcacgaactgctggacaatttcaattgatacatgtttcctgttggtgacagctgccgctataccgcagtaaatcataggaacaaataataatgtggcaagttcttccgtccatgcaaatgaatgattcaaaacataccggctgaacacctggattgccaaaagtatcccggtgaacccaaacaggattgccgctatatattcctcaaaatgggacagatagtattttatatctttctgtgtcttcaatccccccgctcctttcatatgtccgtattagttatccttcccttggcttacttagctgcctggtccgacagatactgattcagcttatcccagcggtcctgtcccatgatggcaaccgccttttcatggacgctttcttccatcatcgtattaaaagcagccaattcctcatccgttaggatccttacctgcattcccgtcttttcacattcatccttatagaactggtttaattcatttacccgctcatatcccttttcttctgcttctgcaatcagtgtcccaaatatttcctggtcctccggtgtcagcccgtcccagaagttcttgctgattacctgtactgacatctggaacagatggtttgtttcagtacaatatttctgtacttcgcataacttatccacatacaggttctggtacggattttcttcaccatctacgactccctgctgcagggccgtgtacagttcactgtaagtaacgttagtaacagaggctcccatggtctcaaacgcagcaacctgaagcgggtcggtcagtatacgcatctttaaaccctttaaatcagagggcgcaacaatttctttcttattatttgtcatctgccggaatccaaagggtgctattcccttaaatatcactccctctatgtcgctttctgcacggctgcacatatcctgtttcaggcctgcctcaaggatacccctgacctgttcctcattgctgaaaaagaatggtatattcatttcggaaaatgcattggtgtaatcgccaaaatttccaattgacaggcagttcatctcaaaagccccgctctttaacccggatacaatatcatcaaccgttttggccagcgtaccgtctgcatataattccaatcggtatctcccatcggtccttaagggcagttcttttgccaggtggaggaccattgcaggaatcgccccgccgtttgtgtcaaatgtattgctggatgtgttattggtataacggatcacctttgcgtccggatacttgtcagctgcccattcacaggcttctattgcgctgattccagtatattcatcaccattgtccccgctggctgttttgctgctgcctttgttatcctggaccggctgtccgctgtccgctcctgccttgtcctgtcccccacagcctgctaacaatgaaagaaccatccccatcgccaataatgtctttattcctcttttcatgctcttctccttttccaatccattttacttgacagtaaccatctgcgctgttttgatgacttcaggttttaattcctgaccaatccccggacgttccgggatatcataatatccgtccactggctgatagtcatataaacaggtgcttctgcaatccggatgcagtgcccacccatgatgctcgtgaatgatgaagttaggcaggaccgcctcaatctgaagggctgccgccttggaaataggactgccgcacacatggatctgtgcagcacagtcataggtgtttgccatatcacagattttctttgcttccgtaatacccccgcacaggcagatatccggctgtacaatctgcagcgagcggtcctcaaggaactccctgaagcctgtccgtccgtaaatccgctccccgctggcaatggggatattcaatttcttatgtacttccagcatgttctggggattcatggggtggacgggttcctcgtaataaaaaatgttcagcttttccagccgctgccctaactggatggaggtagtcgtatctgtataggaatgcagttcgatgatgatgtccatatccggcccgccggcctcccttatggccgcaaccctgtcgtacgcagtgctaagttcccgctcagacagtactcccctggtcctccattcgccttttccatccggttcctgcctgcttagggcaatgggatccaccttcacacaggtataaccctcttccatgacttttcttgtaacagccgcgtaatcctcgggacggatcattaaatcccggtccggtacaacccggtccgttccccatccaaattgtatctggctcgcatagacccttaatctgtcattggtctttccgccaagcagtttatatacaggcacaccgaaggcctttcccttaatatcccataaggcaatgtcaattgcactcataccagcgctgacaatggttcctcccccaagcccccagaatgtggtccggtaaattttctcccatatcttctcactgttcatgggatcttcgcccagtatgacctctgcaaaatcctgtatcatgccaaatccggcacggaatccttttccgtaagccacaccgacctcgccaaagccggagattccttcatccgtattgattctgatgatgaccggattccaggtgttccttcccttgcatgggttgccgctgtctattatcatacagtcaacactgacaattttcatatgtaccctccttattttaattaaatgattggttgtttagttgttcgcccgattccattatagcaaattgtatagttttgtcaactgtttttatatttttttattcgtaattattaaaatacgattctggcatacaaaaacaggctggaagtaatataaatacttccagcctgctgcaggatcattattcaaatctcttccactgcccttccgatggttttggcagccttcctctcctcaaattctgcggcactgccccatttttttactgcccagttggtcatgagcggtatcaatatcaaagtcacaataaccgcacatgcgcactgtgccgttgcgctttccacataaggcgccatctccggaacagctgccgcaaacatggcaggcgttgcagctgcattgcccgccgtacttgcaatagctgcgccagcatagcctggtctccggttaatgaatttatcacccaggatacagaacagcccagaaacaccggcgcttaaaacccccagcatgattcccggaagccctcctgtagccaatgtcttaatggaaattcccgcccccaggcagaatgagaaaaacggaatcatgaaggtggggccattttgaaggaattttgctatatccctatccaaattgcccaaaatcatccccaccaggaccggtccgattgcggccagcagtgccataaccggtacatcagccagaccggtcgccccaaataccagcatggtcagaaaaggcccgtcattaatggacagcacggactgagcgcctaaatccttctcatcgccgtagatactggtcagtgacatgtacagtccggcattggagtttgttactgctgcaacaatagcaatggctgagattcccataataccgctcatgccgcacagatgtgcaattcctacacccaggacagctccggccaggaatttggataacatcaatacggttccccgtttcagtacctcgcccgcctgcctgaagtcaatctgggctcccacacagaataatgttatcgcaatcgtagtgttggttcctgccgaagaaaacatagccgtcgtcaggccgcccacctgtaatatctgtggaatgaaggtgttcatcagcactcccagaaagagcgggacaatcataagcccgcctggtatcttttggatattcttaaatattttcatatatagttccctccacagtccataatgatagttttaaacctttcatgtattaaaataatagcccgataatttctttggccgaaacaccgtgtatataatcttccatatctatactatttaatgcttccataagactgttttcctgatggcgctttcccctgagcagcagttctaactcccggatatccctgttaccaaaaaaatccccggaaaactttaaacattccatataaccatgttttgtggaaaatgtaacatggaccagccctgatgcaaattttgcctgattcgcaaaatcatatcttggaaaatcaccataattccacttccatgtggagtatttttcatgttgcaggcgccctatctccttaagttcttcttcagagaaagtatccgccggatttatgtccattgaccggaacaacctgtctttcatctgggctgcggttacctttactctgagatggtcatttacattgcagacacggctggcaactgaacgtatggcccttcccgtatatttttcagcagatggcctcagtaccctgctcagtgcggtaagatccgaggatatcaataatgttccatgatgcagcaaacggccgttatgtaataattgggaacagcctgaaatcttgcatccgtccagcagcaggtcgttccttcctgaatattctgcctttagccccatccgccctaagcagtcagccacgattctgctgaattgggaaaaatcatagttcctgtcagtgtgatgtaaaaagagggagtagtttaaattgcccagatcatgataaacagctccccctccggttaacctgcggaccagtcccacattttcctgtctgagaacatctgaatcaatttcagacaatgcattttggttttttccgatgactacgcagggagcattctgccataacatgaacacatcatccttgctggtattgagaaggtactcttctgctgccatattaaaatatggatttacggatgtattgtcaatcaaccgcatggattatatgctcctcttttttgttgacggaatgcagcgcccctatccctaggccaaggatgctttcggatatggcttctcctgttgtgggatgagggaaaatcacttcagacgcatccctttgcctgatgtggaactgtacaagttctgttatggaatttataagggtagaagcatcgggtcctatgatggagccgccgattatttcgtctgtaacacggtctttaaccagcttgacaaacccatctgtatctcccataatcagagcctttccatttccggagaatgggaacttatagacctcataggatattccatccttctggcaatccatttccgtttttcctacagaagcaatctcaggcatggtaaaaataacattaggtacaatatcctgtttctccccgccatccattttcagtatatgacgtacggccgccatcccctgatgtgaagccgcgtgggctaactggaggatattgttcacgtcaccgatagcatatataccaggcctgttggtctgcatgtgcccatccacctggataccccgtctgtcccttctggtttctatgttggcggcttcaatattaagggtttcataatccggcacgcgtccaacagccattaaaaccttctcgcttactgcaaatgcttcttttccgtctttttcgtaaatgacaaccgcttcctgatttaatccgttctcaatccggctgaccctggcacctgtctggattaggatacctttacgttctgcaattaaccgcagcctgtctgagatgtctttatcaaccattgggagtatgccctccagatactcgataacctgtacgctgacgccaaggctgtgatatatgaacgcaaactccataccaatgacgcctcctccgataatcgtgatagatgacggcagtttttttaaagacaatgcctccctgctgtccattacctgtggcagctgtactccaggtattctgagtcctgcggatttagagcctgtcgcaatgatgatgttgccggcacttacatgcacctgaccttcttcctgttccacaactacctcattccctgacaggaatctggccgtacctgcaagaagcttgacactatggttcttaagcaggccgaggattcctgaaacaagcgtttcctttacctcatccttccattcaatcaggcgcggcatattaatctgcgggtgcggtacttcaattcccatcttagccgcctttaatatatcctgatacgtcctggctcctttattgagggcctttgtcgggatacatccttcattcaggcaggtccctcctactgtcctggcctctgcaaggattactttaagcccattctgcgccgcatatatggccgcctcatatcctcccggaccagctccaataataagtaaatcagccttttcctccctgcatttcttaaccggcgtgctcctatttcctgccgcagtctccttgcatccggtatctgtgtccatcctcacaagcacatcattcaggacgatgcggtctccctggtcaacaagcacctcttccacaataccatctgcaggagcaaggataggcaggattccctttgaagcctcatattgcaaaagttcatctcccgccttcacctggtcacctgccttaacagatagggaactgacaattgcatccgcccccataagaaattctaattttatatccatgacttcctccccgtataccaatccttcatttcagtttcaggagcctttactccaccatggttaatgccggttcgtcaaatggtacgccatgattgattgagtcgcctaccgggcatttcctttctgcaatgcttaacagctgacggatcctttcttccggcatgttgctcttcacgtaatagtggaaccggatgttctgaaaaccggggcgtacattcggattggcacctgatatcccgtctgaatccttgtcgccttccacttcaacccttattccatcaatttttatcccatacatttttgcaaaaatagcggtcgtaatggcctggcaggctccaaggcttcccagcattatctccactggattcataccttcatccgtaccccctgcagtaagcggctcatccactataatcttatgtgaccgcgcttctatttccattttgactccattaacctgatttactgaaacctgatatgtctttatcgccattattaattcctttctcactttaaattacaaacctgtcattacatcgtatattgcaataccccctccaaaggaaggggtatatatggtaaatgacttattagcagaatccgccctgcccatttaatgggtttacatctccttcttttggtacaatgcaaaggatatgtaatttctcagtcttggaagtattccagaatgtatgctctaaaccaccaggaacatgcatccatgaaccgctttcaatgtcatactccgtcccatcgattacaaatttcccctctccgccaatgcacagcgcccaatgtgcccatgggtggctgtttggcggggctactgaaaacgggtccagaaggaagcttctcatgacatggctgtcccagaaccggccatccggtccaaaaacaatgcgcttttctgctcccaggataaaattagatgcatccacagtgggtaactcctcgatttttcctaccagttttacattctcttccatcatttaatttctccttattcacttcatatttttgcatacaaccggtttgaatgccttgaattgtttgttgtaatttgataatatatcattatgcaatttcagtcaattacgcactttaatgtaaccattcaccaaaatgtaagcaattacctaaaagtaatcggaatattcaatcaacggagggggacttatcatgaatacggaagaggcacaatgccctattgaaaccacactaagaatgattaacgggaaatggaaattaaggatcataaaagaattgctgcattccaatataagattcggacagatattaaaaaatatccctgatatttcccctaaagtattgtcgcagcagctgaaagaaatggaggaggacggcattatcgaacggattgtcatcagtgaaatgccccctaatgttgagtatgtcctgactgatatgggcgaaagccttttaaatgtctttaaagaaattaaacgatgggggatgttcaatcttctgaattatgaaaagaaatcagtaaaatgtctgcaatgcagacaatgccaggatacaaaatataactgttaatctttaaatcgaatagtgtccgtgttatctgcttatggaaaacaccttggttcctgaatgacagtttcagaagccaaggtgttttttccatctcattcacatcagcaccctaatgtaaatgagtcggattctgttttaggacgggcatttgaatagatattgttatctccatatatccatacttgccggtatttccctagagggtcagttcttttgcaatggttccttcataactgccccgatatcttcaaacacaacgcccttacaataccgcatcactatcccctctttgccgccctcctcattacccaacgtaatttcccggaacacaatctgtttcaactcatatccaggttcatcaaacccgcacagttccattgcattacagttcctccatccctctcccccatccatataacgtccctggatatggattctttcaaaactataattttcaaaaacaggagggacttcggaacctgctccatcatcattataatctacggaatgaatcatcagtctgggaatcacgcaatcccgcacatgaacttcccgcacatagccgccccgttttttcgttgccttaatctcaatcccatacctggaaccagacaggtcgcagtcccagatacagacgtcttcaattccgcctgaaatctcacttccaatggcaataccgtgtccgcaggcgcttcggcagtcaaaaatatggatatgtctgcttggccggttgattctattcccttcgggatttttgccggatttaattgcaacagaatcatctcccgtataaaaattacaatcaaacaccgtacagttcgtggaggaatccgggtcccagccatctccattccagacgccctctgaatggaactgacaggcatttgtcacaactgcgtccgaataaatcatttgtacattccagcttgcgccatttttaagcgtaagcccggataacaccacattccggcaattgctcatatgaatcaggcgcgggcgcacccgtccgggtattgtgtcagaattctcatacgcccgtaccccgtcgcccagctccgtaagatagtccttcagccgttcacgttccgactcaatcacacgccgcgccagttccctgccgccgctggcaatggtcccgcctccgcagattaccacgttacggcaattataaccgccatcccggtcaagttcccccaggttcagaagactgctgtagcactccatctccgtaccctcaaaccggctcctgattctgggaagatagtcctttggaatatctgttccctgtagtgtggcatccttttctatgtatagcatcatgttgctatgaagccggagcgctccggtcatgaatacacctgggggtatatagaccatgtccttcgggccgcattcatcgattgctttttggattgccctggtattcagggtcttcccatctcccttggccaggtatggctctctggtaatatccacgcgccgtcttcccgcttcaagttgtatgtctttccccggcagttcccatagaactgccgggtctgcttccgccaggtttacttccgccgggtttactcctgccgggtccgccgcttccatcccaaccatctttacctttacatggcactgccgctgtgtctccggcacagtaaagcctgcatgggtttttaccacggtctgctgtaatacgccgtctacatagacctggaaacggcagcccggtatccattcttccggtttaccccagaatacggtcaccctattccccacgatgaccgtctgtatctcagtccacacatccgctgtccggtctttcattttatccatggtttccccgcttattgcgatacaatgaactgcttgatatcctgatacatatcttcataatcttctgcatagaccttaagtcttataatccggttcaatcccatattcaggacacccagaaaggacttagcgtccacgacaatacttcccctgaacaggtccatatgaaacggatatttttctacccggccgacaaaatccccaacttcctttgtattatgaaaaatcagatccatcttttttctcctctcctgtatactatcccttgattccgtccattgcaatcccatccaccagataccgctggaaaataataaagaacaggattaccggaagcagcgagattaccgacatggcgaacaggccgccgtagttgttatatgagtttgggtccagatacatgttgagcgccagcggaattgtgaaccgctttgcactgttcataaatatgagcggctggaaaaagtcctgccaaatccagtaaaaagcaaagattgacgaggtgatgattgccggtttcacaacaggaatcagtatacggaacaggatggcaaaccggccgcagccgtcaatctgtgccgcttcatccagatcccgggggattccccggaagaactgcaccatcaggaatatgaagaaagcgcctccgaaaaaccatggcaggaccagcgctgtcctggtgtcaataagccccagctttttcaggatgatatactgcgggacaaccatgacctggggcgggatcatcatggtcagcatcacacagccaaaccagaaaccggaaaaccggaacttaatgcgggacagggcatatgccgcaaacagtgaagtcaccacgcagcccgctgttccaatgagggtcacaatcagcgagttgaaaaagaagctggaaaatggcaccccgccgaccccgtcaaacccgctcccgtagttcttcgccgcatcccaagccttaggtatcagggagtaggtatctaagaacatggtttcgttgctcttaaaggaactggccagcagccacagaagcggataaatcataaaaaatcccaaaacacatgcacaaacgtggaatttcacagaattaaccttacttttcatatgcattcccatcatcatccctcctctgattcataatagacccagttcttctgtgtcttaaaaataattaccgtaaataccgcgatgattgctaccaggatccacgccagggcacagctgtaacccatgtcaaagaaggtaaatgccctgcggtacagatacagcacataggacagtgtgctgtctaacggacctccgtccgtaatgacgtagctttccgtaaatacccggaaaccattgatgatctgcaggatcaggttgaagaagatggtcggtgtcagcattggcagggtaatcttccagaatatatatccctgtttcgcgccatccaccttcgcggattcataaagcgctcccggaatctgttttaatgccgacaggaaaatcaacatagatgaaccaaactgccagacgcccatcaggatgataatgctgagcgctgtcttgggattgcccagaaaggaggtggcctgatggatgccaaatacggataacaaggtcatgaccacgcctttatttccgaaaatctgtttccacacaaccgatacagcaatacttccgccaataatggacgggacgtagtagatcgtccggtaaaggccaaggcacttgtggtccttattcagcagcatggctacaaacagggcaaatgccaggcgcagcggcaccaggaccagcacatagaggaacgtaaccttcaaagcctgcacgaatgtatcgtcctgtgtaaatgcccgcgcataattggcaaagccgattatcttaggcgtattcagcaggttaaaatccgtgaaggaatagtacatggaaataattgccggaatcagccacatcccgatgaaccccagaagccagggtgccagcagaacatagcccgccagattgtccgcccgcttatagactgctttcgtctttttcatattcataactgctctcctttaatatcagaggggcccgcatccggcggccccctcatcatcattctgtccgttattccccgactagttattcctcgacaggattgcatcggcatccgagcggaatttggctgctgcctcctgtggcgtgatctggccatagaatgccgcgtaagctgcgttcttgaatgcttcattgacttcagacatccctaccggatccgggtccggagtctccccgcacagttcctgcgccttctttacgttttcaaacatagccacctgctgtggggaaagcttgccggaattcaccatatagtcgcgtatccctgaggaaaccggggtcccgcgttccgccatgatgatatcattggcctcttctgaattgacgaaccagttgataaattcggctgcttctttttttaccttggaggtctctgccacggaaaagaacattcctggcttcagccataatcccttgttatctgaaccttccagcatgggaggggtaatcatctggattttatcgtttacgccgcttaccttggatgcatagttattccactcaatcagggacgcgccgtctccagtcacaaccgggcccgcctcctgtccaagggcctggatagccgcatattcgtcgggattgggcacagcgccctttgccatcaggtctgcccacatctggatgaagtcagcgcagaccgcatcatcggaatagccaatagctttcttatcatcggagaacaggtcctccccatgctgtcttacccagtagttaaagatattggtatcatctaccggtccattggccatgccgtactttcctgttttttcttttacagtctccgccatggaaatcatgtccccccaggtccagctgctgtccggcactttaagtcctgcctctgccagcacgtccggattgaatccaaaggactggtaggaacttgccaggaccaatccaaccatcttgtcgttgattttaccggaattcagcaggttctcatcaatgtccgcaacatcaatggtgccgtctgttatgtatggggtcagatctgccagggaatcatttttcgcataggtagtaatataaagataatccatctggacgatatccggcatggagcctgaggctgcctgggtggccagcttatcaaaatagccgtcccagcccgaaggcatggtctcaaaagttacattgggatgggatgctgtataggtatctaaaagcttctgggtataatcatgtcttccctgaccgccccaccaggtaatcttaatcgtaaccggccctgaggcctcaccgccagccgccgtacctgcggcctcagcactgtctgccgcggtatttccctctgccttgcttccggaatcaggactcccgcatcctgtaacggacattgccattactgccgcaagccccaacgctgcaaaacgtttcaaagattttttcattatgctcttctcctttttcttatgggattctgttgtttctctgatggttttattatagcgttttgttccttccggttgaatggaattatcagattccgttgctgtaaaaatccgacttttccattatcgtcctgcggtattcggatggagtcatccccgtccgtttcttaaagactttggaaaaatactgcccgtccacagggtatcccgtctgttcagccagttccgccactttaagttcaggattgaatacaatcaggcgttctgccagcgaaatgcggatacgcaaaagatatgcggaatacttctcattggtatagcgtgaaaaaagacggccaaaataatcctcattgacataaaggacttccctggccaggtactgggcgcttagttccggatttttgatattcttatagacggcatacagaagctgccgcatccgttcttcttccttaccctttgaaaacgccagatgcatatgtcctgcgcatgattccaccacgttttccaaaagcagccatggatcagcttccgtaaggtgcatctcacatcgtatcccacagtttttcccaaacaggaactccagcgctgcctggaataccttatacatctgttccccagaaaatcccctcagccccatcttcacatatgcggcatagatttcaaacagcaaggtatcataagcctgggcgctgcggatctgggtataatccactatcatccaggaactcccgtcggcatccggccgcatgtcgtatgtcagtatttcctgctgctgcggaatatcattaagtcggagcagttcctgggtctgtccatataaaagggcagtaccatttattcctccatccctgcttattgctgaacagagtatggttttcttatatttccggtactccatatgggccttttttaacagtccgggcagacgttccctttcggttgccggaaacaggcagatgatttcattccccctggccgcgcttaaatatacattctgattgccagccagttcttccagaatattaatcagtacgaacccatccagttggtcaaaattcttctggctgcgggttgtcacaatcaggaaggatttaggtacattttccagaaatttttccaaaagtacttcatccgtcttggcaagcttctcctgttcaatcaggttttccaggatccgctcttttacgtgcggaagcatcaggcggtatacattgcggtattcctgctctgtcttcttctgctcctgccttcctgccagttcctgtttcaccttgcttaacacctctgcaatccggatttcatcgcatggctttaaaatataatgccggattcccagttccatggccctgctggtatactcatattccccgtatccggacaatacaatgaacatgatatggggatactcctccctgacccggcggatcagctgaatcccatccatcacaggcatcttgatgtcggtgatgacaatgtccggctccttctccttgattttctccaggccctcaaagccattccatgccatatctaccagggtaagtcccagggattcccatggaatgattgcagccatcccctccctctcaatgtcctcgtcatccactaagattactttatacatgcgtcttcctgcgcctcccttttcggaatggtgatgattaccgtggtcccctggtccggggtactgtctatccagaaacctgcttcctggtcaaaggccatcttcagccgctctgcaatattcttaagacctatgccatggcctttgggcctggctgtgaatttgcgcacggcccgtagctcctcaggcgtcattccaggaccatcatccgtgacagtaatgcggataaggtcctcctcctcccgcaccgtcaccgtaatcgtacatggagtcagcatcttctccacgccatgatatatggcattttccaccagcggctgcaatgtcatatgcgggatcagatattgcccgcccacctttgcatcgatggaaaaaaccgcacgtttctgatagcggtattcctggattgtaatatactgctccagcatatgaagctcttcttccatggtaaaatactgctcccggctcaatgccgccctgaggatcgtccccagcgccacggtcatcctggccgcctcctcattcttcttggcacggatcatccagttaatgctgttaagggtattatagaggaaatggggattgatctgcgcctgcagcatccggtattccgtatcttttaagaggatctgtttctcataattttcatggataaggttgtcaatcttatccagggtcatctggaactcctgggtcagaagtccgatttcgtcatttccgtaacctgtccccaggaattccctggcccccaggaaatcacctgtctccacaattgccatactttccgtcagccgttccagcggttttaccagccggtaggccagacgccttaaaacccatgcggtcagaaggaagagcagcagaaatgcagcaatcaccagataccgcagtttctggttctgcccatagatttccgaataggaaaaacggttcacatacatccatccggtcttggaggattttacgtagcagagaaaatacctctgtcccccctcccggatgatccggtagcccttatcaccggtaagctggggcagctgcccagccatatgctcctgttcctcgtaaatcacgccttccggggaatagatgcagagagtcgcgctttccgcctccagttcgctgatattcttttctatcaatccctggacatcgctggatatcaggatggtgcccagatattccaggctggcgtcaatatgcttgcgaatatcccggccggtcaggagataagggtattccttggtcggctgctgtacgacatatccgccctttgcctcatgtatccgcgccatgacatccgcgtaaagcccctcttcaatctcacccgtggcagtccctacaacaaaccgggtgtcttttccattggtatagaggatattggaaatcatatccgaaatcatcagttccttgtccaaaagcatccgcagctggtaagtctcgtaagaatagtcagccgtaaaatgtttcaactccttgattttggaaagctgctcctgaatcttggtgtcaattgcaatatagtaggacagattctcaatcccatccaggttccggttcacctgctggataaaaaaatccagttcctggagggatttctcatacagcttgttgtcatagatgcggaagctgatgtgaagcgctgccacacttagcatgaagcagaccccaagcatgataaaataaagcccgaccattttctggaccagcttcagattccgtaaccgctcatgaagcttcagatcccggaaccgtttatccatatcctgataccagcgcatcccatcctttttcatcttaccgccccgttttccccattttcttttattctatcacagaatccacaccatgaaggattcttttttcccttaatccatggtacagatcctcatccgtcatatggttttcttcattggtcagcaggaatatcccctggtcttccttcctgtccagtaccagacgctgccagtggtagaaatacggtccctctcccagattcctcacataacccatcagctgatgcagcagataaacggtctgtttcacatcggtctggcagtcatttccataaaaccccttccatttcccgtggcagctcccttccatggccttctgcgccagtgcaaagcagtctgccgcctgtcctaaaaggaaaaatgccttcaggtattccctggctgcaaaggaatcatacgcctccccaaaaaggacggccccttcggcgctgtacccatggatcctggcctgaagcagaaatgaatcctgccataaccggctttgcctgcccgctgcctcacaacatgcaatcagccggccaaacgccggcagtccattccggcacaggtctgcaaaccaccgtatctgtccggcaaaatcccggtccggcgcgcaccactgtaattccccgcatcccttctgcccgccgtccatccgccaatggcagatcaggattcttgtgacataatgatagaactgttcacctgcatgttcatcctcatttgtcccgtaaggaatcatggcattaaaataagccttcacacattcttccatgccttcctgtgcatccgcctcataatattgttccaaataatgtttcagatgtgtctccggcccatactgccggccgttccacagagatgcaagaaagtccagcggatagacgtggggttttacattggagcagtttaccagccacatatggcggattcccctgtggtaagccgttctcagctcacgctccacaaattccatggaattagggatcattgtcagcacatttgctgcctgcaggtcataaaaagatacatggtaatagaccccatgacggttcccggatgtgtcctctgatatctgtgcatccggaagggccggtatccgcggattatggtttccctgccttctggataccattttcccatatccattgtccgcccagattgtaattacatcatccggtatttccaggtatccctgcctgtacagttccatggtttccccgtatagattcgtgcagaaacagggattccctacgtatttctttaccagatggtactgctcctgcataatgctgctgattaacttcccccgcttttcaggggtgtcatattgcgggtcatgttcccagaaaggaatatccccctgtcccctgaatcccagattccagattacgttccagtccttctgccgcaggattccttccctccacagctgccggaacaaatccggatatagctgaaatgacggttccaggtccggataggcccgcaggaacatctccgcgcccaagggttctgcatggtgctgggtaatccaaagccccatcccggcggccagatccgcatatattttggaattcttatccgtaccaggaatcaccaggtttcctccgcaccgcagcaaagcttccatagccatttcccagggatattcactgtttttcccgccgtcccagtggctgatcagcacctcgtcgttgatgaaccatccgcggaaccttactttgcgcggttttgaacaatattccccctccggtatggttacttcccgcttcctggtaaacttctggtcgttccagaaccagaacggaagcacccccagatatgtttcactcaggtaaatcaggccgtatataaagcccagttcatccgccgcctcaagtaggcactgtccatcccctgcccatatccggtaggattccggttccatagagccgttttccggctcacgaaggtatattttcccacgcccctccattggttcaagcgtcatatccatatcccggtaaaacctggccgcagcccggcgtatgggttctgtttctttcctgatctgcatgatgatttctgtattccctgtcagcctaaacccttccatctccatcctcctcaaatctgtattttttcagtataatcttaaccaaggaaaaagagaacggaattttcctttataaaatctgaaaaattccgctgtttccggcttcctcccctttggaatagtattctttcctttaggaaaaaagcgctgctcatgtctggttatccacacatgaacaacgctccggaaaatataagactttataagacttacctttccaccgcatctttaatccgttccagcgcctgtgcaagcaccttccttgtcactgcaatattaaaccgttcaaagccttcgccgcaaacgccatatccctcgccaaaggtcagtcccacttttgctttttttaaaaataaatcatgtaattcctccgcggacatccccatctccctgcagtcaacccatacaagataaccgctctccggccggatgaccttcatccggggaagattcctctccatatattccgtcatataatccagatttcctgacagatacgtgtttacttcctgcagccatgaatccgcctccggactcatggctgcctcggatgcaacaatactgaaactgtttaccgcaaaatcataggaatatccggtcatggccttttcatacttttttcgaagttccttatcaggaatcagcaggatgcagtgcgtcagtcccatcacattgtatcccttgcttggactggtgagcaaaaccacatgttccctgaccttctggctcagtcccactgccgtgatatgttcatgtccatcaaacaggatatttgcatgtacctcatctgaaatcatgaccactccgttatctgcgcagatggttcccagcgcctccaattcttccctggtaaaagtccgccctgttggattctgtggatttaccataaaaaataccgcaggatgatactcttccacctttctcctaaaatcatccaaatccagttcatatttcccatcaacaagtaacatcggatttataatcacctcacagcctgcatcctctgcacatacaatgattggatggaaatgcggcgcctgtaccagaaccctgtcacctggtttcgcataagttccaaagcagattctggctgcaggccagacacctggggtatgtaaaatccactctcccggaacttttagattgtaccggcggcaaaaccatccggtaattgcatcataataggaatccggttttaaagtatatccatactgtcctcctgatgcgaattttattagggcttccctgatacacggtgcagacagataatccatgtctgcattgctgagggcaatcacctccggatcctgatattggtcccacttaatggaacctgttccaatcctggacggtgtactgtcaaaatcatacatatgttcattcctcctcaatatattgcaaatattacttcttgatactgcattcattcctactttctaaaatatgacagtatttacatcacaaggctttcatttgccatgaagtatagctttttgccctttcaaaatataccctgatattgaactgtatttgcaatatattgagaaaaggccgcagactatacgtccgcagccttattcgatatagccttaacctttttcctatactccgacggtgcacatcccaccttctttttaaaacagtttgtaaaatggctgaatttgtcgaatcccgagtccattgcgatttcacctatgggcatgttcgtatacgataaaagattgattgccatcatcaatctgtaatccgtaatatagttaaaacagctcatctttaatttacgtttaaacagccggcagatttcctccttgcagatatggagatgtcctgcaatatcactgagggatattttttctttgtaatgttcctctatgtaaataatggcatcgcggatacgcttctgctccaaatcgaattccgaggaaaaatcatcgatgaagcttttattttctgtaattaaaatatgccataatgtaatcagatccgagacaatctttaattcgtatccaaagggttctcccacatacagatgataaacttcccttaaaatccctaaaatctgattctgccatggtatcccgtcctgcaggaatatggcggagagattaggattcgtggtgaatttatccacatatttatgtccgtcaaattcgtggaaaaatacatagaaattctttaactggatggtaaaattcatgtatgcactgttttcctctaaagcttttgccatatggattttatccacattgataaatatgccctccccctgtttcactctatatgggatattctcaacccaaaattcaacgctgccccttgtcacatagctgatttggatataatcatgggaatgcagcatgaaacagcctgttaatgccaggatgttggggttctgatatacagctatcagataggttattgctcctttggttttttcattaatcaacgtataggatgacggtatatcatagtaatccatatcagttttcctccaagtcggctacagtcatattttcataccattctatcagcatagacagagaattacaacacagtactcaaccagatgcaaattttccacaaaatcagggtattcagccatcctttaaaatattattatcgtgttacaaggctttcatctttcacacagatatttactcaactttatttcaggagggagaagttatgtcagtaagaccagaacaggaaaacagtggggtttatcacaattgggaggtacggcaatgaacatagaacagattgcagccgcgttagataattttacctggggaccggtcatgataatcatcatggggataaccgctgtcttttttacaattttaatgcgttttccccaaatcaggctttttaaacaccttatcagcaatacctttggcggcagaggaaaaaaggatgggatttccccattccagagtttctccattgcacttgggggaagggtgggcactggaaccattacgggaacagcaggagccattcttgcaggcggacccggagccgtgttctggatgtggcttatggcccttcttggttcggctaccgcattcgccgagtcaacccttggacagatattcaagaaaaagataaagggagaatatgtaggcggtcctgcattttatattgagaccggtttgggatggaaaaaaacagcttcggtttatgccggtgtaaccgcctttttcatgctggttttcgcaagcatccaatcgaatgcattttcttccatcgtgaaatccagcttccacgtatcctcggccttaatcggacttgcttatgcagtactattatttcttgttatttttggcggggcaaaaaaaatcgccaaggttgcggaagtcatcgtgccattcatgacagccggatatattcttttggcagtcataatgttcatcgtgaactatcatgaaatcccacatattttcgggatgatttttaaatctgcatttggaatggacgcagttttcggaggaattgtgggcaatgcaatatcctggggatttaaaagaggatcgctcagccatgaggccggtcaggggaccggtgcaatggtatccggaaccgcagaagtatcccatcccgctaaatccggattagcccaggcattttcggtcatcgtgacaatcctgatcagcacggcaactgtattcatgattttctcaaccggcagctataacgtggcttcacccgccggcggttttcttatggagaatgtccccggactctccagcggagaattcacttcacatgccatcaatgtttttgtacccggatttggggcggcatttatttcattagccatgttccttttcacttttacaacggttttggcatattcaatctatctggaatccagcgttgtatatttcctcaaggaaaaggcagaatcatccatgctgaaaaaatgtatgacagtcctgaatgtacttatgataggtatggtgattgccggcgcatttgtatcagccgaccttgtttggagcattgcctccatatgcagcggtatcgtgtccatcatcaacctgattagcgtattctgtttaaggaaatatgcaatcaatgcactaaaggattatgagaggcaggtgcatgccggaattgaccctgttttcattccagaggactgtggaatccaacatgcacaattgtgggccgaaattgtggatgggcaatatgcagaagaaaaagcagcgtatatgaaagcattttactaaagatatattataaaggactgctgtccaggaatttgaccaatccgtcaaataacacttcattactttaggagcatgaaggtccatgtctactgccaggcaatccttccgggcgcaggacccgtttattgatatgcaataattccttgctgtcatctaccagcaggactgtcttccccgcatgccgcagtgaaacagccctgcttttagactggctggtccatgtctccctcagttttaccagttccttctgattgatgggggaagtcacatttcttcctatattccacaaagcagcctcacccgttcatgcccatatccattgcttttcagttccggcgccaatctcaaaatggtatttcacaatgccggtattaatttgggacatgggactattgtcctttgtgcagatggacacggtattcccatcagcttcaataaaaaaattctgtctgttaagacctgttggggcaagaacagccgcattcatgccatttataaaccatgcctcactgcacggcttacatagacgttccatgctctttgacttatgcggcgtaccgtcagaagcgccataaccaatcgcaatgacaccagccaattcctcatcaggagctaacgaaaccggacactttttcgcattgtacgtatttgtgacccagcacgaattcaggcctgcctgttgggctttaatcataagacgtgctccatagtagccacacttctcataaaaaccgctttgctttctggctgccagcgcaatatagtttttcacatttttaaatctgccaaataggggaatgaagcttttaaatgccccctcgtcttccgttattaactggatatgcagctgtcccagcttgttacactgttcaatttcttctttcagtccacctatgactgccggcgggagcggttttgccgtatagttcctgaccgcgtgcctcgccctgattgcctctgattccgtcatgatccattcctcctatcccaacttatgttacaacattactttgttaagcagtatcctctccgtaagggcgccccagtcaccattttcatactgtatccctttcatgttagccattgccgccagaccgtgtacggttgcccacattaccaaaaggtcatcccttaattctttttcatcaatgcccagctccctcatccctctttttgcaccatttacaaaaacttcaaatggagtaaaggagcggttccatgtgatttcggtttcttttatctgaatgcccagatactcactgtcaaataagaaattaaaatagtggggatactttgcaaaaaattccacataggcaacgcccatggaaatagcaacataatgacagggattatcttcaaccgcctgctccaggacggctgtaaatctgcggacgacatacccgtacatcccttcaagcagttcatcaatattcccaaagtgattataacaggcagccgccgatacaccgactttcttcgccacctttcgtaaagaaaacttttcaatcccctcctcatggattaactcaagtccctgttcaataagcgtttcttttaaattaccaaaatggtatgggggttttccgcttgtatctgtgttcatatcatatccctccaaattaacaggtgttaatatattatatccattatattaacacttgtcaacatttcaacggtatgttacatgaaaaaaattgccggccatcacagggatgaccggcaaactgatttttcaagtatccttccttgccttatttcttctatatccttctattccttttattctgtatcaggaacattgataatatctgggaaatcagctgcagggtgctgacttcctcctgggtccacagacgcagtcccgtgcactcgtcaaatcccacaaatccggcaaagacagcatccgcttcaaaggcacactgaaggacggaacagataccctggctggaaaacaaagcttcgtgctccggtttcaggctgtggatatcccggcagtagaaaatcatattttcatcaaaaagagtttgataatccccatgctccttataattggcattctgcagtcccgccatcttggaagtaatgccttcattgcaccactcataagtattggacccgtattgcccgtcttccgtattctcaaatatgtaaacacggctcacatcaaactgcttgcccacaatttccaggaccatattgaccgtacggtcaaaatcctttgtctggtaaagattacggaacacgtagcgcgccaggttatcgaagccctctgcatactgccgctccgaatcaattgcagcgcctatggatgacaggccgcttcctcccatatcagccgcagtgccgtcattataaatcacatagttattctttcccttgctcttagcctgatataaggctttgtcagcgctggcatagatttccttaaaggaggcgccgtcctttggatagatggcaatccccatgctgcagcttactttaataggacttttctccgattcgaacagatggcggaacagatgcagaagttcctctgctttttcctctgcgtcctcagcagaagtaatatccttcatgaaaaccgtaaattcatcaccgccaatccggcccaccacatcgctttcccgcatcagctttttcatgccggaggcgatttccgtcagcaccacatccccaatcatatgtccctgggtgtcattaatctgcttaaaattatccgtatcaatcatgaacagggcacctatggtatccggattggacatgaggtacgttccaatctgatgctctgtctcctcccggttatagataccggtcaatgcatccttctctgcccggtgtctcagtgtctccatcttccttctctcttccgtcacatccagccctacgctgtagatggaagggatgccgtcccagctgtcatccccgctgatatagcacagggttaccgtccatatacgttcttccctggagcgtgtgtacgcccttgcctccagcaccacattttccccggactgctttaatcccctggccagcttgacggcccgcttaaaatcgtccggattcatatacgtacactggttatgtaattcctcctcaaactgcaccttcgtataaccaatcatcttgaggaatatgtcgttgtaccacagcacggtgcggtaatcccggatatcaaggcgtatcatgcctgcgggaacggtctttaatatggcctccctttcctggtcctttttggcaagcttatattcagtgctgtacatgtcataggacagctcgatacgcgccctgcgtccctcccagtttatcatacggtccttgatgatgaaggtgcgcttcaggttgggattgtaaaactcccattcataggtcccgtcctcttccagatactggttcgtacaaaatggacatggtgaggatcttccctggatgacctcatagcactttcttccaatcagcgcatccgcatggacctgcagcgtttcactggcatgcttattcaggtacagcagctcatatgtgtccatatcgctgatgtagacatttcccgcgtattcggacatcatccacctgaaattccctgtctctttctccctgctcctgcccagcctctcctgctccagcatccacttactgatgtccgagtacaggatatagaggattggcgggccgccttccggtgattccacgattgtgccgttcatttccacccatatggattccccgctacacacagtcatgggagcctgatatacggcgcttacccggccctgtgcatatgtctcctcaaaacaggccttcatcccgtcaaatacacccggctccattccgtaataccgcctgaaatcagggtattcacgtaaaaaatcctcttccttatatcccagcatcttataaaatgcgggattgcaccaaattatcgataacggatcatccatataatgtttgctgattccggtacccagtaatcctaaaatgtcctctgtcatcatcgttcttcctggctgtgtcatcatccaaccgctcccattgcctgttcatgtaatcatatccctcgattataccaaaatgccccccatattacaaggagatggcacaaggacttttccataaccatgggaggacagtccaagcctgcggaaagcccaggaatcattttccgtcatccgggaaatccgggaatactgctcccatcattccctggactccctgtatctgtgaaggtattccatctgggcatcatcgtccgcctgacgtccgtatggtatggttcctgcagcacagcaatagacgacaattcctatgatgcatacggctaaaagtatcaggataactgctatcatcttcttcattcctttccatcctgcttatgtatcaagtctgggatgcctttatcggtcccatcctccccggatacccccatggccagcagcatcagcatgacaggcgtcacgatggggacgctgatattgaccgctgcctgggcggcataacagattaccgcaaaggcaattgccatcacgtagggccgtttcccggccgaacggatcattttccggatggatgtaaccagcaacgccagataggccgcaagtccggccagccccaccgttaccagatattgaaggtattcattatgggcgctgtcgaaaaattccccatagcgcatcaccatctcatcataatacttctccatgacaaccgcaccatatgtatcgggtccggccccaaacagtttctgtgtaaagggaaagcctccatagctctccattccaatcctccatatgtaccagcggtgcgtcccccagtcgtcattgattgccaggtactgcgccaatccgccgtagtttcctgcatttccacggacattcacatcataaagggcaaagcaggccaggatgaccaccatggacaggaacgccagccagacccacctccccctgttcccatcctgcataagggggtgtgtatccggcagcctctgtatcatccggcacagtatgaagtacatggcccaaagggccgccaccaggacaatcaggtaatgggagccggatatgacccggtacaatcctcccatatggcctgcagcgccagaagacggctttgtcatcctgggaaggatccagaattcagaccccagcactgcaagtatgaagatataagtcctggccccccttaggttcttgaacgcgtacagtggtaaaagcccaatcagggccagtattgcaaggtaggcattatcgctcattccggtaatcagtgcaaagaacgagactgacatgcaaaggagataccatgctttccttatcccggcctcctccgtaaagaatagcagggcggatgccccggccagcagggctgcataggatgtatatgtgttaatattcccaatggtggatgtgaacatatagtattgttccggatccatcagattcttaaagccgatgggatccatatcaaagtactgaaggattcctatgatgcaggccgccatgcctgcccccaggaacaaatccagataccattgtcttaaccgcaggttcttgcttacggcaaaatacatgaacgcataggcaatccacagcagaaggccggagaacctcccatcgcttcccatcagggccgcagccggagacgcggacttcagggtggatatccctgctatcagtatgaaatccagcatggaccagtcagcggcgttaaacagccggttcctgcccgggttcctcacacagccaagatagattgacaggctcagaaagattccatttaccatcaggaacacggctgcaaagataattacaaccctgtaataaaaatatgtcttaaaattcagtatgtcaaagtaataatccctgaacacaagggggaacaccccaattatgatgacagcgaaaacacctgccagtgcacaattcgtacttttccatgctgaatggaaccttacgatatttaaaatgccggtcttcttactactatccatgattactccctttaaggaaatcccagaagcagccatggctgataccatggctgcctccgatactccatctgtttttacatctttaaatccttattcttccggttcctgcacatataggtattggcctcatccagcatgcgcatcagttccagcgcgctgcggaacgcgatataatgcgttcctgtgcagctgcactgaagccttccctgcatggatgaattctgtctatacagcacatggaccaggatgactgactttgcagctgtcacaaaggggaacatcttccctgccacatcctctttgaccaggactttttcaggcttttttttctttttccccttaagcgcccgatactgctgctccctttccttttgcaggaaacgcggttctgtggttgccatgggggcgcctaccatttcacatacctcatcaagggccagtaccatcccatggatacctttaaagtttacagggcggggcagatgataattcacaatgataccgtatggcacattattttcatgtccgttgatacacacaagcatcatgcacgccctgtctgtacctgccatttcaatctgacggctcttttcttcactcagcatgttacactcctttgcagcacaaccgcagacatatgtctggaactataatcgcctgttttacggtgtttccctcatccatctgccattctcatccaccggatatccatccggggtcatttcatttacatataacgttcccatcggccttccgtccaggcctccggtgctgaagtaataccagtactccccaagcttctgccatccggttgccatgcctccggtaaactggttcagatagtaccacttcatgtcctttgcatcatagtaccagcccatgaccagacgtccaaagtcagctcccagattatcattaagatagtaccagtgtccgcccgcatccatgtaccagccgtaatccatgataccggccgcattaaaatgataggtgcaggtctgccgggcatcctcgtactttatgttgatccattggtctttgatggttcttccgctcctcaggataaaggaccattgtcttccatccgtgccaatgctttcccaccgtccttccgtgccgacggcataggtcctgtaatcattaaaggttgttcccggcccaaggcttctgcccccgccggagccgccgcgtgagccgcctccaccgccgcctccgccgttgcctcccggccggttgggattgtccgggtcatccggatggttcgggtcatcggggttatccggcggattggggttattcggatcatcgccgccggaagtgatggaatccacaagggcctttaatgtatcataggtatccagaagctcgtccacggtcggacggtagatcctgttggcaacttccagtgcgatatcaattgcatcgcttaattcttccttatcctcttcgcttaccgatggattgtcctttaatgcctgggctatggaaatctggcccaaaagcttctgccttgcctcctgccactgggtatcatcttccatctggtagcgcacatgcagggtcaggttctttgtgacaggttcgcccgtgtcatacccgttgttcgaggaggctgtccttcccagcccatcatactcccacacaactccggtaatgggatccgtataggcatcgaatatatccagttccatgaatccctgcgcatcctccagggccgaaccggacctgaccttgatgatatgttccacggaacgcttatcatcgatgatcctcacttcatgggccttcaggtatgtaagtacataggtgccttccacatttgcatcaaaggacacaactcctgtgaacccggaatccgcgtcatccggatccggctccatgggcacctgcgtacatgtatattccccgtccaggtcctccacgttccacagctggtaatccgtatagccttgcatgctgcggtcaaggacagcgtatatcctgatatccggctccttgtccacaccgggcgggatatccttgttgctgcctcccacctgtcttgtcagtacggacgataaggtccacggtacctttaccgcatcattgccaacttcggcttttacagcctcggactctgatgccttgggcgcccgctgggtgaacttgactgtgtagagcacgtcaacccccgctgtcatggcgtcctggtcgctgctgttatccgtaagtccgtcaatcaggtccgccatcctgtcatctgacaggtcaagggccaccgcccctgtcttaggcgtatagtcaatggaagcattgccgggtgtcgctgccgacactgcggcataataatttgcctgaagcaccaggtttccctccggcatggtgatggtggggttcctcctggtcttatcggccagtgtcagcctgccgatcagcgcgctccactgccggaatgcctgtccctggctgttggtggtttccgcatccagggaaatcagatccccggcctttaccactgctgtcttatcatcgtcaaagtcaacggtcgcgccgccccgtacgattttagtgatgaatccgccatttgtaagggctatggtataatcctgctgttcctgtgaatttcctatgaccgctacctgggtgcccaaaagtatcttatcggcagccccggtgtcctctcccggctgttttgcaaccaccacgtataactggtttggctccagcccgccaagtacggcacggggcgtggcgccggaagacatgacccatccgtcctcatctgcaccggggacatccattacatccccttcaatattaaggattgcatacagggttcccggatctgcaggctcaaccaccacctgtttcataccgttcccatcgtcctgcacatcgtaattgctgccaagggccggtaccgtcacgcgcgaaggcgggctgaaggtacctgggtccaggttctccggaaggattacccccacatccgggttggcgccctgggtcatctcatagacatagtagcttgtacatgggtttaacccggtaaaaccggcattctttaactggcttcccagtttggtcccaaccaccttataatccatatcagtcaatgcgtacctgcggttttcgttggcgcctgatacgctcaccttcccgctgccatcgcttcctatggtgccctgggcatccggcatggtcagtatgttatcatcgctgagcccgatggggatgaaccttgccgtataggtctggtccgcgttgattgtctgtggaccctgcatcctgttcccgttttcgtcaaaccagccgtcaaacatgtagaattgatcgggatgggtgctgggaagtatcagggatgaccagtatgtgcctatttccacatggcttgtcttattcccttctatggcgccgtgaggcccggagacaaacttcaggtcaaaccattcgccttctgtctcctcaaagtttgcaaataatttgatggaggtattgattaccgtgtcatctgccagtcttggtcctgttttattgcttccgttggatgtggccttataccagccgtcaaaactgtagtgggatgagggcgtgggcataagcccttccgtcacctgggccagggtattgtccccggactttttgacaaacttaggggccgtactcccgttaaaggatccgttctggccattgtagaattctacttttgcccaatagttctcatccgtcaggtcttcggtataggtgatggttacggtcccaccctgaagattcggggtcaggctcagtttcttagtctcctggtccagggatacctctgacaggctgtcctcccatacgatattgggcggatagacataacctgacatttgatccacgtcaacttccaccggaacaccgggattcacggaccgcgtctcctcttcccgcaggatattgccgtggttatccatacgcttcacccggagtatggtttcaaagctggggtccagtccatattgataggtaaatgtgatggcctggttcggcatctttcctgtaaagtgatagtcagatggattaaggctgacccctgcatcctctgcagagatgacgcccgtaccatccagatccgtgattcctccgtccgtcagttccgctgattcaatcagataggaattaatgacagccggttcaatgacatagtcggattccaccggaagggccctgctctccggggctttaatctgattgccttccatatccacgtaccgcaccgtgattgggaattttttcgctgggtcaggctcataacggtaagccgctgtcaggttgtcattgggcatactgccccttaccgcataggtggagtgattgatgctggccccgccctccggcatggtgccctgtccgcttgcctcgccgtacttgcggactttattgttctttatgagaacggacttaaaccggtatcccggtatatcccttctgtaggttgcggaaatgggattgttggccatctggtcactttcccaggatgattcgaagaatttccttaaatcaggatcctcataatcctccggccatccgctgctgtcgttctcatccgcctcatcccttactgtgttaaagtccctgtaatgctctaccctgaatgtatagggagttgtctcattacttttccacaccgcgctgtaggttgtcacggaatcatacgggaaagcatatgggagtgtgtccacccggttgccgttggctccataccaaccgtcaaatgtatagccgtcccatgtaatgccgctaaaatccggtacctttggccttgcccctgacccaaagttatccgtgggcagtcctgcaaagttggcggaactggtcaggggacttcctgcctgcccgcttgccacaaacagactgccctccatggccccgccggatgccacaccgctatagctggaaagctgtactcccggcccattctggggatcgaacttaatcttaaccggatccccgaaattaaccgcatatgccgggtgtcccggggcagccatggaaaataccatgactgccgccagcatccctgccagctttgattttatattatatctctttctcatccggttcctcctactgaatccatgcaccgtcggcatctgtctggtatccgtccggtgttatttcattcttatacatggcgcctaaggggcgtcctgcgcctcctccataggtccaccgctggctggctgggtcataggcatatacgcccgcccccaccgtggagaagtagtaccatttcccatctatcttcctccagccctgggccatcacgccgctggccggatccaggtaataccagttgccgtcccctgtatccagtctccagcccgtgagcattttcccgtaaggtaattcagtctccgtgttgcagtaataccagtttcctgccatatcacggatccagccgctctgcatgatacccttgtcgtcaaagtaataccagccgctgtcgtccggcctggtcccctcgggatagtgcagcttggcccacatgccgctcaggcgtgttcctccgttgagcacgaaactcagctgtctctcaccggatggcccggtgctctccacccagtttccgttagtgcctatctgatagctcaatggcgcggttcctgcaaatggcgccctcttacttccgccgccgcctccgccgccacctttgctgccgcctttgttcccgctttcctgaaggtcatcgtagtggtcataccgtccatccagcagctccttgtacggagccgtcttatccttcagttcgcgcagggcttcctccagctggtcgatggttgccttgggttcttcacggtccaggacttccagcgccgcctcaatatactccttcagcttcttgctctcgcccagcttcaggaaatggtcgtcgctgatgccgatggcctcccggatggcctcctccagctctttgcggacatcgtccaattctttctcattgttgtcataatatgcgtatacataggtcttgcgggttatcttgcggtccggttcaaattccctgtaacggtcctggcggtaactccagcccagataactgtactccgcccccgccgggctgatgaaatagtcaagctgctcttccagtcccccatactctgactcgtaataggaatctgccggggactcctccctgcgcaccttgaaccagtagcggtagatatccggggccgtgttattgaggaaatacacccggtaggcgcggttatacaccattatgtagcgccgtccttccgtggcagtgaaggtgaacaggccgcccgtttcttccggttcataatccataggcaccaggcttaccaccatttccgtatccgggtccccgctgatttcatacagctggtagtccatcatatccacatcctgcctgcccaactgtacataggtattgaaggatgcctccgatgcgcttgcccggttaaccttcctgccgttcacatatctttcgatggaaacatccaggccccaggccgccttgtaggctgcttcatggtccgtatcgtagctgcctcccatcttgatggcattggattccgatgcgcgtacgctgttctttctatataccaccttataggtcacgtccgcatggtttacgtccagcagttccctgtccgcgtccgtggtaagttcatcctccaggaccggtatctctccaggatccagggccacctcctcacggctgcctccccgcacctcgtccaccacggtggcgttgcttggggttgcggcccgttcatataccgctgtcaggaccaggttcgtatccggcatggtgaagctggcttccctggaattaatcctgttttccataccttcaaccgaaccgatgatgaacttccagtgggagaagggacggttctcatcgttgactgcttccgccttgatcttcactaaatcgcccttgtgggcctcttcatagcggtcttcccctacggcttcatcccccacgcttaccacctcaccgttcagggtctcgatgatgtaggccgggagttccaggtcgccgcccggatccgtagtgatgacgctgccatcttcccggcagctttccgcggtgactgcactttggccttttggacgggccaccaccgtatactccttgttatagtcaaggccgctaaagcttacgcttcccggattgcccgacacgccctgccatccgcctgcgccggtctggggcgtggttaccacatggccgctgctgtccagtaccgcataatccgatgccggatccgccggccggatgatcagcctcgtcttaccctcgtcttcttcatcatataggatcttatagttggtatccaccaccggtgtcagtacctccacaccgttgctgagcgtaccttccacatccccaatcatgtttccggcctgtaccgttgtctgtcctgttgcctcgtacaccagataacgcatgccgggatacaggttgtcaaatacggtgcggcttgtaagtatgttgcccttgttgactgccagcaccttgccatcaaggtccgtaaggatatatttataaccctgcgtggtaccgaataccgtgattcgtcccttgccctggctgttaagtcctgcgaccggttccgggtccgtcacctcagtgccgaagatggccgggtccggatagaactggatggtataggtctggccgttcatcaggtccatatcatcgtccaccggttcgccctgtacataccagtcatccaccagatagtttacctccggtgtgtaggacggaagacttgccgcaatgtccccccatttcttatcaaaggtggtgcgcagggtcaggggctgtcccgcgtcaatggaaccgtggctgcctgccgcaaaactgatattaatccaggcatccggattctcctcgaaataggcggttatggttgccggagccgtgaaccggtaatcctggggcaggattgtctccccgttgtccattatcccgtttccgtccgtgtcgataaaccagcctccgaagcggtaatagttgttcaccggccgggtttccggcataagacgccgttcctttatggaagccagggtataggactgctcccgccctgcaggcgaaccgtcatccaacagcacgctggccttaaatcttcctcctgacaatgcctgcacatcctgggatacgctgcttcctccctgcagggttccgtttgctccgggcttatatgtgatatctccccacagtgccggaatcctgtcatgcttatacgtaattgtcacatcatcattgggcatgatcccggaccagtcattgccgccaaactgtatctgtgaatccgccggcctgaccgtgtgtgattccaggctgtatccatactgctcctggtatacgccttctacatcgctgtccgctgcataaggtcctgaattctcaggcggtatgatgtcctttaagcggctgtccgctgtcccgttgtcttcatatttgaccgttatcccatatccctggatggatgactcatacaggtacacaagacgcaccggctggttgggcatgatgccgctgaacatgaagctttcatcaaaatcacctctcacgccgtttaccaggccgtccgccagttcgcctgcctcatctcccaggtcgaaccggtaaccgatgcactcatagccgtaaacctgtgcgggctgggcagtgatttcattttccgggtaatacaatcctgactgggcagcagataccgtggtcccgttattggtttcatgcaggacctcgaacagggacctggcattggggtcgtcatatctcactttgtagctgtagcgtatggtagcgtcctgccccggcatcttcccggtgaacgtgcccgcgccattaaactggcctatggggacagaggtcccgctgaagttatattccgatggggttgtgctggaatcgtcctgactccaggtatatcccctgaccgtcttcttctcctccagtatcggttcctccacgctataggcgctgtccatggtatttgtatcaaacatgatgtcccctgagacattggagtgctctaccgtataattgaatttaacactggggtccgcctcaaatattgcataataggtgataggtgtctccgggtaaacagccggcagccggtcgatgatctggggatggtcccagtcatttaccggactccagcctttaaatatatagccataccgtgtggttgtgggaagcagtgaattgaccggattcccggcagtaccgaccagggtctctggttccggtgtacctccgttgctgttgaatatgatctgtgaacccaccttctggtattcatagttcactgccacatcctggttgggcatggttcccgtaatcctgccaaagtctgccgaccccggcgtcaggtctgccgtcagggacggcggtgtcccctgttcaatgaccacattggacagctcgtatcccgtgatggacggtccgggcgcaagatccacaggttcccctgagcctttggaaaccgggggaatcggggtaacgccggggatggagccgcctgtctgtgcgtccttcaccacaaagctgatctgaagcccgttccgtttgattactgcattcttatcatttcccgttccggcgccaggcaggttccttgtccccaccgacacatacacaccggtgccgtcagcttttgcctggtctgcgaagaaattatccgcaaaggggcttggggctgtatccacgccgctttctggcaggggcaccgctatttttatctcctgtccggcttccgtggagattcctcccggagaggcagccggctgctgggccgtggtgaccccaatccttgaggcgtccaggtcacccgtcacggtaatggtccgtcctgtttccaggtatatattggccttggcgcctgaaggggtcgtgttgtcctctgccatcacgtcattgagcacatcaaaccttcccgtgctgttaaagtaaacagcgcccttgccctctgacaggttcccggataccttgccatagttcatggagagggctgcgcttcccgttatattaagggcgctgccctggctgctgctgtccccatggcagttcttaagttccgccccgctgtttatctccacccggccggaaccggctgatacaagcgggtcactgcctatattgccgctgccgtccaaaacaaggtccgtcagtttcagggttgccccggtaacctcaaaaatcggcccggtataggaaccggcgcgtcttaatgtcttgatataatccgcatcctcgttggtggggttgccgttcctgtcataatccgtacttgctatggtaatatccttactggaaccggaaaccggtatgggggccgtgatatccggataatccatgatatagatataccctttcttattccctatctgccccatggcatattcgatggttttaaagggactgctgtaggtgccgtcggcagcagttgaatccactccggtttctgatacataataggacgtgtccctgattgcaaatgcaacccttttatgtaccatctcatatggatgaagctggaaatgccaggaataggccataccggagtcagtcccgcttaaggaatccccgccgccttcttcgaacacattatttccccagttactatagtgaccaatccatcttgtggtcgggggcgtgacatcaaggctgctgtcgttggtgatacagtcaaaggtggttttcacatactggttcaccatatggaaacccctgttatttttataaaccgtggcatagtcgtcttccttgctgccgcctatcatgacatccgtgcctgtccccagttttacggatctgccagcggttccgccctgccccgtcttgtcatagacataataatccacgaacacatatttattgtccgggcttggtgagagggcaatcttaagttcaattcccatattggtcagatcttccaccgcgccgttggcagttccgttggccttatatttgttgccgttatccacctggatataggtggcgtatccctgccagctaaaagtagtcttaatcccgcttctgctgtatcctgtctgccctgcctgcagtccgcacagatcaaaacggtaagtgttgccgccaacttcacctgtcccgccttggggaccaatccatgcataagccgttccctcgctggctccattccccagattctcattgggaagctccgtggaggcatatgcaaccattgccagatgcgatgacccaagtcccacaatcaggcagattgttaaaatcaaggaaacgaaacgtttccatatctgatataattctttattcattcctcacattgtctcctcacattaaaaattcagccgttcttcctccggcaatccgtccagcagaggttccatattactccctgtaatcagaccgcccgcatatttatcttccttattatcagaatcataatgatagaatccggtaccttcttcccctttatgccatcttggcttaaattcgtcatctaccctggccgcaaaccggctgtttatgataatgagccatcccccgtccttatccctgacaacctttttatttccagtgacggtctttccgttggtattgaccacccggtaagaattttcattctccctgaccacaccgtaaccatattcctcatccgcttccagcctgagtccatttatatagtaggaatcctttaccctcttgaggcggttgcggtttccgtaggcaacgccgtcgcttttaaacccgaaggtgtataccccgtcctccagttcgaccttcagctcatttccggtctgcatggagccgtcattcagctcgtccggtgaaaagaaataaaggtccgccttctcaatgccatagatattcccctctatgaaatcatctgatgaccatgcgtccatgtcatactgggcaacgaacgtgctgcgtgtgtcaaagagcacaaatccggtctgcatcctgccaagtccgtcaaatgcataataccggccattgactttctttatcttattctgatatatctttccgttctgatccgtgcgccaccagctgtactccccgtcatcatagtcatcctgaatcagattgtccgacggatacatccagagccaggcgttcctaagaaggcttccgccgtcatacccggcatagaacctggcgggcgcatcgctggtgggattgcttttatccgcattgctgacgctcgccaccttggtccaccagggaagcatgattccatactcatcaaagccgtaggtgctgccgtctatattcttttgtaccagcttgtccccattgctttttaccttcttggaccggttgttaaaatacagccatacctggtcatattcgttgtagtccctgccgctgatatcgctggacaggtcctcaagcccccttatctccagctgcgaataatccagccactcctcagtttttaaggcgccgtccgcatccgcatagtacacgccttcctccagcggattgtcctcctcgtccagcggattcccatcctcgtcaaaccatccggtcagcatgcggccgctttcatcaaatatgtaactcctgccatccacggtcctcttaaaagaagatgcggtcccgcggtacgccttgccgttggcgccaaaataataccacccggcctcatgtccatcctcatccgcctcatccaccaggacccatgtatgttcagcccgcgctccatcctcaaacacataatacaggctgtttccctgttcaatgaaacaatccctcagcatgattccctggctgcccagatagaaccaggaatccctggactgcctccatgtattttgcagcggctcatcattttcatctaaatatctccactcctcaccttcgctcatccatccctcaaccgcataagcggtcactgtctggaatttagtcagtgcaaaagccgtaacggccagggcgctggcaatgagcatgattctccttttcttcatcctgctatccttccaatccttattttaaatatttatattgaaccctttatcaggggtagttttactcctccaaatacacgtatttgtttttccttccgtacaggaccgcctcttcgtgggtatcaaaatagatatccagctgatttccctttaccgccttcccggtatcctccaccgtgtaaaccacgccatcaattacaatccgggtgccaaggggaatcacggacgggtccgcggcgattgtatgggctgccttgggcacggtttccgtcttggtaagcatttcctccttttccccacaacacagcggacagctgcaatagcccgtgacctggaactcccccagacaatccattccttctaaaggcccatcggaatgtctgtatacaggacagatcttccgcccgaactgttttgcctcctcataactgccaaaataaatccgcagcttctccctggccccttcatccaccttatcctcaatcacataggaatccccatcaatcaggaccgtatcccctattttgaaaacagacagtacgccggccgccgtacgcccgttcacgggaaccacgccggaatatgtcatatccttcccatccgaactataggcagccacctcaagctcccccaaatatgtaaactccggctgggttgcctggaccggtgcctgtgacggatttaagtccagcgcctccacgggatacggattgtcaatggttcccgctccccccaggtctgcccgggcctgttccgcacctgccgtatggagctggaccaatgtgaatccggccgccaggacagtaagaccacagcccagaaggaatggcctgagatatttcctcatcatattatgcctttgacaggatttcctgaattccgtcatcctgtatccatgaatgttatctgtcatccccccgccccctgagcatcacaaattattatgcatggaatccgaatccatatctttctgcgttaagaacttccatgtgctgcctcctaaacttttatcccaggtaatatcgcagtatctccactctccgtcaatccaggtcctgttccatgcatggtttccggcatatacaggttcacatatcaggcccgcgcttctgcacagcatcagataggcggatacatatccccagcacacggaacttccgtccacgaccgcatcgtagatggtcttattcttaagcgtctggtcataggagacatgattgtagacccagtcataaaaatattccgccttctccctgtcccccaatgtcctgcatgactgcaccacatccgagagcctgtcctgtacctgtctgtgttccgataccgccttatccgggttcccacacgaaacgtagatggcagacttcccattttcatcaaatgaatacagtgtcacttcttcttttcccagatatatgtaccggtaataatatctgccaaaggaaaatgcttcttcctccgaattaaaaacaatacctgtttttatataaccgccgtccttcctcccttctttgagcgcatccatcaccgcttccccaagagcttcaaatcctgtattccggctggtcatctgactggccgaccggcctgtgaagactgcctgcccgccagatggttccggctgctgcatggcagatgaatgtatctcaaaatgaatgttcatgataaataaaatggccaaaaaaaggcagatggaactgaacttcttaattttttatccctcccatcctgtatttacaactgaatatttcttttgttgtacttaaaaaacagggagggggacgataaaacgggacaattactgattatggaaaattttaggagaattgattccgaagtttaagaaaagggtaaataacaaataatctgttaaaatattcaagttggtttaatttgtgacccagcttggttgctatacccttttttatcgaattatttttaaaaatatgtagaattttgtcaataaatgtagtatactttttttaaatctttcaggagtatcctaaagtacaacaaaagaaatattccgttgtatcctgcaatagcagtctcatcttttcaagctgcaatctgtgctggcttccactttcctttgtataaatcctggttgtattaatatccctgtgtcccaggatatccgctaattttgacaggtttttttctatttcataatatgtccttgcaaaaaggtgtcttaggttgtgtggaaaaatcttttcattcttaactccggcctccatgccaagagctttcatttccctccatatgttactgcggtccagggcttttccgctttttgtgacaaatatcatacctgtgctgatattcttttttgatgcataagactgcaggattgtacaaagctgtctggttaacagcacggtccttatcctgcccttgcactcaatctccgcctgtccccttcgaatggcttccactgtgatgaacgacagttccgatacgcggatcccgcttacgcagatggtttccagcacaagggccagccgttcattcccattggcaaaagccgtttttaccagccgcccatattcatcctttgtcagttccttccgctcaggataaaaggaacttttgctgatttttaaaaacttactttcacagccatcccatccacagtatttgaagaatccgttgagagcggctatgacgcagttgatggtgaccggggtcaaacgctcccgcaggtctgctttccataacagtaccacctccttggtaaccggtccatctcctatgaactctttaaactgctttaaataatgtctgtatttctttactgtctccctgctcctttcgcaactttccagccattgtccatactcctctatcttctggtaagttatgatcctttcattttttcttttcattccagcctcctgtaaatgtgtatttgggtttagtctgctcagatggcaaaaaaacatccaatatccccttaaggatgttggattgttctgcttattattagacattcaaatcatatcatagcgttttttgaagctatgacatatagtctaatgaataactatatacggtttttaattctttgcatactaatattttcttacattttacataaattttacataaattttacttaagtacttccaggacgcaggcgtgacgcgcaggcattgtcatatccaggtaccataaaaagataggatgattgccaaaatacaataaataagggtgcggccaccatgaccacacccaatcttacagagtattacagacatctgaaacaatattgaccgctatctcttttgcctttgcactggacaccgccctgccatcggacctgcctatatatacgcagaaataccttctcccatccggcgtgtccgcaaagcctgtaaaccaggaatccacaacaatccctttatcctttcccattccggtctttccataaatcttaaccaccgcctcatcctgttgcgttaccagcatgacctgttttaattgttcaagggtttcctccccataatgtgtatccctgccaaaaatacgttccatgacctgagtctgctcttttgccgaaatcttcagggaggattcaatccagaaccctgtcagggcacggttatcattattggtattcaaccgcccttcccagtctgaaatatcacaattcccatacaatagcccattaagcaccgcctgaatcctgtctgccccaacttcatcaatgatctgtctgtaataccagacacaggaggtgcggaatgcttcatggaaatcaatatccttgttccacttttcattccagaatatttccccactccattcccgcaccgaatgttccggttcaatgattccatcctccatggcaattaaagaggatatgatcttgaaggtggaacatggggagcggcgggtttcaaccagctcctggttgtaaatcatgtattgttcttcatctggatcataaataacagcggcgccgttcataccgtcaaaatatcctgaccagtcatactcggtaattgccgatacggtgcccgtatcctcaaccgtctccctgggcggctctgtgtatggcggtaattcctggggagtccggatggttggcggtaattcctgggtagtctggatggttggcggtaattcctgggtagtctggatggacggcgctgtccctgccggttcaggattattattcccattcttgttgccagcagaacagcctgttattactaataataaaatcatcagtaaaagcccttgcaatcgccaaaacccctttttcgctgatgatggaccgtttggtttcttatcatagcccatggaatgatttatcctctcaatcatatttattgaacacataagtcccccataatcacttatccgccggcatgactctctgattccgccactcttgctccagctgggccagtgaaaccgcatccatcttctccgccatggcctgtacggcctcatccagatgcacacctaaaatctccttaaagaaacgcccaatctgacaaccttccgatatcctgggatggaacttaaacagctcattggtgtcatacccctccaccgccatatatatatcccacagacttatatcttccggatccctggcaagtacggtggcccccctgcctgtggatacatgtaagattccggccttcttcagcttgccaaacagctgtctgaccatgatgggattccctcccgtgctttcggaaatcatttcactggtcatctttttatctttgaataccaggatcatcatcagcatctggactgtcactgtaaattgtgtactcatgcgcatgtcacattccccctttgactgtattctataagccattgtttaaaaagtcaagtgtagccattgacactacaaacaaaatgtgctaccatatttgtagcataataagttacaaatacatagcaggaggtatccatatatgaaaaatgaagctttggaagtccttaaaaacaggcgttccatccgccggttcaagcccgaacagatttcccaggaagtccttgatgttgtcctggaagccggaacctacgcccccaccgcggcaggaacacaatgccctgtcattgtagcggtccaggatccggacctggttgccaggctggacgcaatgaatgcaggaatactaaacaaccagaatatttcccatccctattacggcgcgccgaccatcctcatcgtgctggcgcctgaggatgcaatcgtaccggagattgactgcgccctggcaggcggcaacctgttaaatgcagcctatgccgcaggactcggctcctgctggatacaccgttccagggaaatgtttgaatccgccgaaggaaaggcgttattgaaacaatggggactgccggacaccatgacggccgttgcatccattgccctgggataccccgactgtccccatccgcaacccgcgccgcgcaaatcctcctatatcattaaggtctgattcataaggccgaaaccgcagaacaggcatcggagcatatcgtccgatgcctgttctgcggttttgatatatggttatccttgattccatcccaaaagattcccaatcaacaattccgcctcagaataaagcactgcatttcctgctaattttatccggtcaccctgctgcctgcaataaagcgtgccgccccgccaggatgcctgccgcgcgacaattttttccttattctcctttttcgcccacagcggcacaatatggcaatgcccggagccgcagaccgcgtcctccgcaactgccattttaggtgcgaacgtacggctgacgcaatcatacccttttccttttgccgtaatatgaagcagcagcccctcaaggtttaataccttttcctgattgggttttgcggaatagatactgtcctcgctatccagtacgcatactaaatcacggcctttccatgcttccacagggcgtattccaatggcggcctccatttcgtccgttacctccacctgttctaaccggtacgctgggaaatccatttcataaagaccgtctgtatgtatcacctccaatggcccgctttgggtctggaatgtaatcctgtctttatccgtttcataataacggaataaaataaatgctgttcccagcgtggcatggccgcaaaggtcgatttcaccgccgggagtaaaccagcgcagatgatatccgtcctcttccctgaccgtaaatgccgtctccgcaagattattttcctgtgtgattttctgcatcagcgtttccggcagccactggtccaggacacagactcccgcgggatttccctcaaataatttttccgcaaacgcatccacaacataatacttcatattttcctacctccggtccattcaccagcccattttagtccgctgccggtgttatcagatgtccaaatttcccttttgggttgactgtattatatcgccggcattataataagtaaaacgaatatttctaatagaagcattaggaaaggcgatttgtggaatgaaccggtatcttgcactccaaaaaataatagagcttggaagttttacaaaagcagctgaagcgcttggttatacccagtcttccatcagccagatgatcggttcccttgaaaatgaactgggaatcaagctgctgacccgttcccgcaccggtatcagactgaccattgaaggcgctgaactctatccatttgttgagcgcagcatcatacaataccgcgccatgcaggaaaaggcaaatgaaatcaaggggctggaaaccggaatcatccgcgtgggtaccatatccagcatcacctgccactggatgccggagttaatcaaaggattccaggaacaatatccccatgtgcagttcctgttccatcaaggggattatacatccatcccggaatggatccggacaggcgccgtggactttggattcatcgccccgtccgctgtcacggatctgacagccattccggtaaaggacggggaaatgcttgcggttttgcctcaaggccatatcctcgccaataaaacggaagtcaagcttgaggacctggcagcagaacccttcatcctgcttgaagaaggacagtttaacgaaccgttaaatgcatttcacgatagggggctggaacccagtatcaaatatacgttccatgatgattacgccatcatgacaatggtcgaggcaggtctgggcgtcagcatactggccgagcttgtgctacgccggaccaattataacatcgtctgcctgcccatcgccccgccggtataccggactctggccattgcatataaagaaaaggatggtttaccgattgccagcaagtatttcattgcgtatctgatggaacataaaggcaggctgccgtaaatatcaaattacttaaaatcatcttccacaacaaagtttacattcccatttgatatgtaagacactgttatccagccttttctgcaggacccggcaagtggctgtctttcccactcccatggttccgccaattatatatagccttttcatgatgcttttccctctattgttccagtgccatcggatgattttcggtatcacaactcctccggcgccgatatctcctttccaacaaggtcaatcacgttcttaaatccatccctgtttttaagcgtacttcccagagatgttacaactgccgtgattttctcccgtcccacttcttctgtgaaagtcttcaccccaggcggcatggcacctgcccaaagaggaaataccacaacaatatcatctgctttccctggcctttcatatgtaaccggaatggtctttccgcccatagccatggcaccggccttcacataatttattttcccgccccattccctattgtcattaatcatccttgcagtaacgccaaaacggccggcaagctcttctgcaatctttttgcttcttcctgtccttgaaaaatagtatatctgcatataatacgcctcctgtcctatctcatcccagtgccccatccggccagataccgatagccccagcaaatccaacgcccccaataagttcagtttactataataaaagttctgcgtccacaataagacgaacatccagatataaaaatccagacatggaacagggcagccacaccatacggtgccgctgccttggattgatttataaaatgattgatttaaataaccataccctgtccgatggatgccatccctttacttcctgtatccgcacttagggcagacaccgttttcgtttaatgcgataccgcataacggacagcgttcaatggtcctggaaggctggtattcctgggttgcagcattgacgccgctgctgaaggtaatctttgcaatattcagcttatccttcagaaggtcatatacaatcttaatcatgccttccactgtcatggtttcttttgttaccaccaggcggcactcgggataggcggtggcaagctctgtcttaaacgccgggcctttcatcttgttggtcggggcgccgtccctgattccctgttcctcatagaccttgaggatggcgggaagcagcgggtcgtcctcccttaaaatcagtgcatggtcaaaattcttcaggacttcccaggcagtcttctggatttcattgcatgggaaaaccatgttaacacctggttcgatggaatcctccacttcaatggtcagaacccccgtgtgtccgtgcagatactgtgcttctcctttaaacccaaaaaacctgtgtgcgtactgaaggtcgagtgttgtgatacttctcatatttcgtctccttttcatgcgatttataatttacaggctcctcatccgggcctgcattcgcagcaattgtaggtggagggcacagcaggctttaaaacttacggatcatcatttacattccgggcagattcccctgaaaataatatcacagcctgtaaattcaaacccatgggtatccctgattttttgatacagatcttcgatgacatccatgtccacatcaaaaacccttccacacttttcacataggatatgataatgttcctgacaacggtggtcgaaacggtctgctgctcccggtatctctatcttccgtatcttcccgatttgggaaaggcggttcaggttccgatacacggtgcctctgcttatattgggatattccctggcgacctcatcatatacctcaaccgcagtagcgtgacactgcagcttgttcactgcttctaataccattgaacattgtattgtatttctgttaatcataatccatttccttaatagtatttattactaattaggattatatcctaataagaaccatatgtcaatagtaaactgatagaaataatagtaggctgaatggaaatgcatctggcttaccgcctcttttatccggttcattcttccttcttaccggcggactttacaagatagcggagccatacagcgtcccctgtaagcacatcggcgcctttcagcgtaaaaccgaccggctcatccgtgctcagtccttcttttgtctggaacaatgtctgcgtcttggtggaaccatccgcacagggagcgattaccacactgatttcatcgcacattcccgcctggataaaggaccagttcagcacacctcccccacccagcatcagtgtctcaattccaaataaatgctttaatttcatcagggcctcatcataatccagtgtttcttgtcctgcaatgatataggaaatacccagtttccgcagaaatgctttatatgcattggatgcctgtccggtcaggacctccagcacatgggcggtggtgtcgatgtaggccagcgaattcttttcccagccaagtctgccggacgggtcaatggaaacatagtacatcggtgctttttcagcaacaaaatccccttccgggacctggggcgcatgttcctccaggactggtttgcggtacatggtaaaattgtcatccgtggtaacccgccctgacagccacccctgatgttgatatttgggttccttgccaaaagcgatttggtaaaaagcatctccagccggtccggattccggcatttccataaaattgcccatgatcttgccatccagcgatgtcatcatgtggcagaaaatatatggtctgtccattcttaatcatcctcctgacgataaaatttttcgtaaattgcagcctgataagtttcatatacaggttcaatcagactataccacctggagtcaggtccaagtcaatattttttaaggtttttatacggtttttataggttttgatgttcaaacacccctatcgtccattgttcacaatccgcaggaactcatctgccattgcctccggcccttctttcataccgttttccagccagcagagcatcatgttataaaatgcccctgaaaaatagtacagctcatacttcgatatggaactgaccggcatatcgccgtgggcttcgatttcgcagtcagtaatcacatccagaagcgtggttgacaccttcgcatgatggaatgccaagacaagtccggcattttcctgataaaaacggaatttatacagcactgccccgcggctgcggaaatcctcatttgaatcccctttcccctcatggtaacgcagggccatctgctggattccatagtctatcagttcctccacggacttaaagttgcggtagaaggacgcgcgggccacgcctgatttttcaatcagctcagtgacggttaactttgaccagtctttatgccctgcaaactcaatcagagcggtaaataaacggtcctttacccttttattggctgcctttctcttatccatgatacaatacgcctccttttgtctcaggttggccaattgacttcaaagccaattgtgatacaatatgtatcatattaaagcatgtcagctttgtcaagagaagtatatactatcacaaatcgttctgcattatataaatggaggtagattaaattgaaaaacaaacatataatccggattaatcctgaaacatgcattggatgcggcctgtgcaaaagggattgccctgcgggcaacatccagatagaaaacaagaaggcaaagattctcacacagtcctgtatcatgtgcggccattgcgtggcaatctgcccaaaagccgctgtcaccatgacgggctttgacgaaccgccaatagagattggaaagccagccacattgaacccacaggagctgcttgccgcactgaggacacgcagaagcatccggcaatttacaaaacaacaggtggagcctgaactgatagcccagatcatcgaggccgggcgcctgacacctaccggaaagaatgcccaggacgtatcatatatcgtgctgcaggatggaatcaatcggttcgagcaaccggcggtacggttattccggcggatccttccgctcatgaagctggttagcccggtggcgaaacggacggtaatcgatgagcatttcttctttaagaaagcccctgcagccatagccattgtatcacgcgaccagataaacggcgcccttgccgccgctgacatggcgcttatggctgagtcctgcggtttaggcgtgttatacagcggttttttctccatggccgcaaaccactcccgttctttgcgcaggatgcttggattaaagcgcggggaaaaggttgtcatgacattggttctaggctattccggcgtaacctatcaccggaccgcacaaaaggaggctgcttccgtacggcagttttaggaggcggccctggcatcctaaagccgccttgccaaaagccggatgtaattatagttcgttaattgtttcagtcacagtcatgtcccgtattcttttagccggggcataaacagccgccgacgctgcaaaaacaacaaacaggaggatgaccgccagtgattgccacggcaaactccataccgcatagggaaagtgggcggaaataagaaagccatatagcatcctgctgagcggcagaccaattgcacagccaatcccgccgccccaaaaggcataggtcaatgcctccgcaaaaatcattttcgtgatctggtgtccgtccattcccactgcccgcatagcgccgtattgtttggttttggccgccacactcattgaaatgctattcgcgatatttaacagcgtaaccaatgtaattattcctaaaaagcaaccgatacagaacacaaacgcaagatacgtgcccgatgtgcgctggtcccgcttatcactgaaccggcagccgctccccaccgctgtactgcggagcgcagacacatcttcgtccgttgcatgggaagctgtctgtatcataatgagtgagtatccggatatcccggtcagacgggtaaaggtctcgccggaagtaatcagtgtgatttttccatctgtaaggccattactgctgaatgggtcatatttcagtaaaccggcaatctcaatttcttcctcccccacaaggattctatcaccaattccccatgggctgtctttatcccatgttgcaaccgcatagctgctgttcccatagattttagaaagattgctgccacggcggagagcgccatcctttttcagacaatccagatcaaaaccgtcgaaggaaacaaggtcaaccgtaccggaaaccaatgttcctcccttccactctgccggaatatcaaaactgctgcggcgtccatacacctgttttacaccgctcattccccgaagcgtttccgccagtctgctgtcaatggaatccaagccgtcactgcttgtaatatcaatatctgaagcggctgctgattggggcatgagatgattgacaaaatcaatcaataccgtgaagctcaaaaacaggataatactaagggcaaaggaacctgtcattaaaaacaggtttttctttgcagaaacagcatggtggataccaagtgctgtttctattttgataaagccggtatggaccggatgattcttcattttcccattatccgggtttccagagacagccgtgacaggagatacttttgcagcctgccgtgccggggaccttgccgccagcagcaccgtgacaactcccatcacgatgccgctgacgattccagttacactgataccgaaaagcgggataccggagaattcttctccgacagcataccgcaatacaccgcacaggatccaggttgccgaaacaccaagggcaagtcctatggggactgctgttttacaccagtttaacgcttccagatgcacgaaccggacgatctgtttcctgctcattccaatacagcgcatcattccaaagaattttgtcctctgcgctacgctgctattgatactgctagaaatcatcaatacgcctgcggataaaatcagcaggaacaggattccggcgcttagcatgagcgtttgtcccatggcgctgttaaacaggacagatatggaaaatccgtcatgtttatccgcaagccttgcctgttccatccttgcccccatttccgccatgctgaacacggaagttaccatgaatacagcaaaaatgatacaaagcagcgtcatccggttctgcctgcggtgtacctttgcagagattgggattaaacttaaatagctcttcattcccggcacctcccaaaatcggtcatcactccgtccgacacctgcaatatccggtctgcggtccgggcgatactgcggctatgggtaatcatcatgatggtctgctcgtattttttggatgcctcttttaacagtgagattacttcaccggtattctgcgtatccaaatttccggtcggctcatctgccaggatcaaggaggggcgggtaatcagtgcgcgcccaatcgccacacgctgctgctggccgccggatagctggctgggaagatgattccgccgctccttcaggttcaggaccgtcaaaagctcttccagatattttttgttgggcttctggtagtccagcaggaccgggaaaatgatgttctgctcaaccgtcagttccgggatcagattgaacgactggaaaataaaaccgatgttcctgcgccggaacaccgtaagctcccggtcctgcatggagaaaatatctttgccgtcaatgcagaccttgccggaagtgggtgtgtccaatgcccccagcagattcaacagcgtgcttttcccggagccggattcccccacaaccgcaacaaactctcccttcggtacggaaaagctggcagcttttaaggcgtgaacagcaatatccccggtaccataggttttagatagtgattgaacctctaacagattcatgtcatgaacacctcttcctttaactgatacccaaagattaccaccgccgccttactgtgatattactgtaatgctacaattttgtaggaatcaggaagctgatacggaacaccgtgccctcccccagcccgctttcaacttcaatggtgccgtcatgtgcttcgatgattgcctttgccaaaggaaggcccaggccaatgccctgggtatcctgtgagaaacggctccggtaaaaccgtttgaaaatgtggtgtaaatcctccggatggatgccgcagcctgtatcttccactttaatctgaatgatgggcgcggactgttcccatccaatccggatggaatccccctctttcgtgtggtcaaaggcgtttttgacaatattactgattgcttccagcagccaatcccggtcgcagggaaacatgatgggtccctttccggagagaataagtcttttgtgttccagactggcacgataggaaaaatgaagccctatgtccttcatcatatcggaaatatcctggggcgtcttttccatttccagcgtccctgcgtccagacgtgtgattttaagcagattttgtaccagtgtctcaatccggtcaagctcctgctcggacagttctgcgaacgctttaatttccggcaggtctcctgcttcattttgcagaagcccgttatagacattcaatgccgccagaggggtcttgagctgatgggagatatcggatatggtgtccttcaaaaacgctttgtccttcatcccattgacagcatgggcgtttaataccgctgccattgtattgatttcatggaacaggcggtataattccccctcatggttacaatcgatacgggcctccgcatggccatcaagaaaagcttccatctgatggaccgcatgttccatgatcctgtcctggcggattaagtaccggacatatattgtcagcacacaggccgccagaagcaggaacaggataaaaaatgccatggacagctctttgcagtatacccatagtaaggcttccccggatgcagcaaacaggagcaggacggcaatgacagcgccgataaaccgtttattttcttcattcacaaatagcttcatggcatccctcaacgtacaacattccatttgtagcccatccgccggacagtaaggatcatctgcggctccccgggattgtcctctaccttcatgcgcagccggcggatgtaaacagtgagcgtattattgtctatatagctgccctcgcagtcccacagcttatctaatatcttttctttcgataacaccgtattgggattttgcatgaacagacacagcagtttgtactctgccgcagtcaattccagaaggtcaccatttttatatacctgcccctgtaacagcagtacccgtatcccgttggattggagttctgttcctgctgtgccaaaatcctttacccggcgcagcaacgcattgattcttgaaaccaggacacccagcttaaacggttttgtgatatagtcatcgccgcccatgtccagtcccatgataatatttgtttcctcgtcagaagcggttaagaagataaccgggactttggaaaccagccgtaccatcttacaaaaatcaaagccggagccatccggcaaagacacatccaggatcagcaggtcgtatttcccgtcagaccaaattttttccgcctcatccagcgttcttgcaatgtcagtttcaaagccctgctttctgaacgcaaatgccaggccgttaatcaagctcaaatcatcttccagaagtaagatcctgctcatgtccatcctccttttgacgtccgctgtccaaaaacctccgattcttcaatcccggacatctgttttaaccaagaatactccttaaaacaaaaaacaggacaactgccagcaggataagaaccagaaaaatcatcccgactattttcactatccgcccagcctgtgccgacccctgttctgccatgttccccaacaactgttccaattcatccgcagccccttgaccgaattcccgggcaatccagttgggattgtatttgtcattattcctgccataggtatagcttacggaaatctccacggaattcctggtcaggcttccactattattatatttcctgtaatcataataaaccgtaaaaaagcacaggacaggaaccatcgatgtatacccatcttttatatgaagataatagacatccaggttgtcgataacggtaagcggctttgtgatctgtgctatctgcgtatcattttcataaattgatacataattatttttccccttatcaatgctgtatcccaggcatacccttcccttatgttcaatacagaatttattgtcacacacgccattctgcatgatataaaagcttccctcgttaccatccctgccaacgatttcaaactgtccaaaacgctgttcttttgttatcagatatttaaaaggaacggcttcttcaatcatattggaaatcaatttataatgcgttgtataaagtttctcccctgaggcatccgtaaaaataatctcccgcatatgttccgcgttaaagggtaaggaaacatccatccatggggcctttgcacggaataatacctgcccggaggatgacacctcaaataaattctcaaaatttgatttcacctgttgtattgtaataagcatgtccttaatccttcctgcctgataatccctatataaccacgtatagaccgtgtatgaaattatagcatgccggaccggttcccacaaccgtttcgtgaatccatccataccacaaaaggacaccctgatgagtgtccttttgtgtaaatcctatttgtataccactacatatcttatccggcacggactgccgcaatcatttattccgggtcatcctccatgacaatattgtcatcctttgcttcacatttagctgcattcctgaacacggataccaccaccaggatcagcaatatggaaataggtaacccaacaatattccacatccctttgacagaattcacgccgccggaagcaaccagaaggtaagcaatcacgcccatgataacgcccatcacgattttaatcttattgggtgcctcatcatccacactcagtccgtggatgctgatggtggccagggccgctgccaccgggtccgccatggtggagaacgaggtgaagatggataccacgaacagtacaatcaaaaccttccccagagggaatgtattcagtatgtaaaagattgtggactgcatgcctgccgtattcacgccgttccagatgtcaaaggttccggttgtctgcagctgtacggtcagtccgccaaacacggcaatccagacaatacagaacatggacggagccaggacatttacaaggatgaactgacggaccgtccttccctttgccaggcggcttaaaaacattcccaggattggcgcatacaccacgaaggaagcccaatactgtatgatccagtccgcataccagttatccccaggcgccatggaattgaggatggctgtcttttcaaagggatggtccagaaggtaagcaaaggattccgttcccagttttgcacagaaggtggtagggcctaaaatcagtacgtataccagtatggcaataaagacgagggtggtaaatgaagatagctttttcagcccgtttccaataccggatacacaggaagctgtaaacagtgccacaataataaccgcaaccacaagccacacaatcttggactgaggcagccctgtgatggactcgattcccgcgccgatctgcatcaggcccacgcccatggaacaggccactgcgccgcagagggagaaaataacaattgcatgcaccagcgtttcaaactttttaccctttttcccaatactcgttgtcagcaccgggccaaaggccagcggcttcttcatgttgaatgtgaggagcgcgaacgccacggcgcatatggtgtacatgcagtactgaggcacggaccactgccacatggtctgggatattgcaaatatggcagcctccctggaccctgcttccaccccagccgcaaccggcggcgtcatgaaatggaatatcggttcccccattgcccagaataagagtcctgtaccgattcctccgcacagggacatggtaatccagttccaggtcttgaaatccggcgtggcgtccgggccgccaatcttgatgttgccgaacttagataacgccaggacaaatgtcaggattatgatcaggattgcaatcagttcaaaaaaccagccaaccctgtcagccatgccatataaaattgtattgaggatatttcccattgcctcctgtttaaaaatcccgaatgcaataaaaatcccaagacagacgattgcaggccaaaaggccagtttatttaatttgtttttatcgttcattatttcccccttagaaacttaaccttgccggtaacattaagccggtaacattaataatacacgtcaatgtaatccttatcttcaaagaattctatttccttagccccttccagcttttcatagtcctcttccgacaggttgacaacagggatgcttttattataaaaatgtttcgcgattaacggccccgtcaggatgaccggatcgcttctcaggttaatgattgccgccggggcacagtccagacgcacctgttccagaatgaccagccctgccccgctgcttccttttccaaatggaaatgcaaacacctggcccgccatgttcttctcatagcagtcgcttcgattgtcacggatcagcccgctctgtgggtctgccccgccccagaagcagaatgaatcttttgaatacagtaattttgccctcacattgccggacactgccaccttacactttatgctcactttttccatggtcttgctcctttcacaatcttccctgcaaccgcggtctccacgcactcccacatatttccaaataccggctggattcctctcatactgaagcaatatgtatcaaactttccggaattggacatgatggtttttgttcccagcttctgtgagcggtattccagtatgcagccgtcgctgtaaatctggattcccagtgcagtaagcctttcatacagtccgctgtcctttaagcggtccacggtggcccttcccacgatgatccataactccgtggaatcgcttaccttcctgccgttcatcaggaattccagtttggcgcattcatcataagagaaatgcggacatcccagcagcacgatatcgatatccccgtccacttcatagttggtgagctggcgctctgcctcctccaggtccttgatgtggatttccaccacttcctccggtttctttccgccgaatgccatctcccgcgtctgtgcctccggtgttaccccaatcatatggaacagcgcgatgccgcctgatgaagcagccgtagcgctgcattgtttcagattgtcattggtgatattggtgggcatgccttccagcgcccagatccggtccccgacaatggaaccgaacgcataggaaaccaacggatacatggactcatcctcaaagtattccagcctgatatcatcccctaactttacaaggccctgtgcgtaacggttctccggcacatgcagcccaaagtaaggaaccctgcccgcaatgccgcaaagcagctctaagggacctgcatagcggttggtcctggcgccgatgatggagttataataacagattacattggactccgcgcaggccagctgctgtccgaaggatggctggaatccggcctgatagggcgcgcaggaccaggtggggatggcccccatttttatatgcgacgcctcgatacggcgggttgcgctcattacctccacatcatgtttctggcggtgccattttaacatatcacaggccgtggcattggtggttgtgggaaccgcgaacctggcccccttttcagccagcatttccgcaaatgcaacctgtgcctcccccgcatatacggtgctgtcatcatggcatcccacaatctcaacaaatctgtctacatcatggaatgcggccaggtcgtaaagaacctgcattgcctgctgccggacttccccatggtcaccgttcagcatctccttctcgtaatcagtcagtttcataaattactcctttcctactaataagttcatttttttccatcctcacgcagccatttaaaaagtacgatctccataaatatcattacaaacataaacgggatggaaaccaggatagccaggctttttaacgccgagaaatccgctttcacaaacatcacggataagggtaccaatgtcaataccaggcagcatgccacccttaaacctgtgcttacgttcccgcttcggtccagtttggatgtgacggtctgggccagtgaaaaggaggcggaatccaggctggatgccacaaatccggcaatcatcaccagcatgacaaacggcagtcccttctttcctcccggcagcgtttcaatcacgccatataccaggtcctgtcctcctcctttggacaggatatctgttacacttacaattccctgggtctgggcataaatggaatatcctccgtctatggcaaataagacccacacgctgatgctgattcccaaaaggcagcagagcgaaacttcctttatggtcctgccctttgaaaccttggcaatgaaaatccccatcaaccctgtataggtaagacagaatgcctggaagaacaaggtccactgttccggaaaacccgaattttcaatgggatccgtgaaaaagctcatccgcaggtacttatcccccatccatccaaggctgctgatgaaattcttaaggatgaaattggtgggacctgcaaacaatatgtaaagtaaaaataaaatacacagtccggccgccaggttactgatggtcttcttgcccttctccattcccaggaaggatgtgaatgtaaagattgccgcgattgccagcaccactcccacctggactgcaaatgttgtctcaaccccaaatacctgctttaacgctcctgtctccaggggcactgccagtcccagcgtacacccggccgcgccgatgatgcagaacacaacggaaatatcaatcagtttccctatgatcttcttatatttgaaatcccccatcatgcattcgcagacagtacttatttttatgaaagaaacttttttgttgtagaccgcgtacgcaaccgcgacaccggccagcacgtatggtccctgtgtggcaaatccccagtggaaaaaggaatatcccagggacgcctccaatgcctcaaccgaaaatggctccagatggatgcccggcgcttcgtaataggccgcccattccgtaaaggaccagtacactgcggccgaagccagcgctgccagcgccatcatggtaatatagctgaaattggaatactccggttccccatcgccaaggcggatgctgccatatttaccaaaggcaagataaaaggccagtaccgttgtcacaaaggtaaataacatcaatggtacggaaaaaatcttcgtcgctcccaggaatgcgtcattcactcccgagagcatctgagcgggatacttcgccaaaaagaaaacaaaggtaaaaacagaaaacaccccaacccctgcggtaatcaggctgactccccattcctgctttttatccatccctattcccctgcaaaagcaatcatggacgcctcaagcggaacatcccccggaagcgccgccacctgcacgcagacacgcgtgggcttgtgctcaccgaaaaactccttgtacgcttcgttaatcaggccgaaatcatttaagtccttgatatacacgtccaccctggcaatactctccctgcatccgccgcccgcttttacaatgcttaacagattattcaggaccagggtagtggcctgtttgatttcaaatacatactcgccatcctttgtaagcggaatctggccggatgtgatgatcatgtccccatacttgcggccatggcaatacggccccagtgccggtgatgcttccggactcacaagttcttccagtttcatcttcataccttttacctcgcattctttttattttgtttcatattttattttatcgtttcactttttgttattatatatcatataatacgactatatgtgcattttgtcaataattagtttcaaattatttatgcgttcgtcattattaccaaatgaatatatggtttttcgtgacaatatccaggggggcataaaccagcggggcgggcaggttttcccctgcctttccctgccgttccccctgccgtttccctgccttttcccttcatcttcagtcatcatacataactaacaatgcatctgcgatggctgccccgtcctccgtgatgaatacagggttgatgtccagctcttttaccttgtccttgccttctgccgccatttcgctgatttttacaaggaggtttacaagggcctccttatcgcagaccgctccgccgcggtagccgttcaacagcggataggaggcaaggctttctatcatatccctggcctgttttccggtaagaggcgccggggccagagccacatccttaaacagttccacaaacacgccgcccatccctaccatgatcataggcccgaaatccctgtcattgttcacgccgatgatcatttccgtgccgtatttaagcatgggtttcaggaggacgccctccagccttgcatccggggcatttttcgcgcagttgtccatgacggctgcaaatgcggcgcgcagttccgcctcgtccctgatgttcagcttcaccccgcctacgtccgacttgtgctggatatccctggaatgaatctttacagacaggggatagcccagtttccctgcttcctccaccgctgcgtccgctgttgcggcaactgcctggggcggaaccgggacgccgtggctgctcagatagttcaggctctcgaactcgctcaggctgtgggaacattcatgctttccctcaggaaccgccggttccattggttcgaatgtgcggacggcaaaatccagtatctttttaagcgcggtgcagccatagcgtccggtgggaagcaggggcgtgcccgcggccttcaggatatccgcgctttcctggtgcctggtgtgttcgatgaacggaatccagaacactggttttaacgtcttatcccggcgcgcaatggacaccgcctcaaccatatgggagatggtgtcatcccagatttcaggggtaatcgtataggccaccacgatggcatccacgcccggatccttagagattgcttccatggcctgcaccatcacaggcgtattgtagccgatgccggccgtcatatcaaagggattgttcacggagccatagtcaggaaccagcgtcttcaggtacgcctttgtctcctgctgcatttccgccagacggatgccgtactcttccgacaggtcggccatgacgcccgcctcgccgccggacacgttcatgaacacgcagcgttcccccttgggcagttcttccagccatgagaatgccgccgcaaggctcataagctcctccagatcgcctgcctccacaacgccataccgtttaaacacggcgcgcagcaccttgtccgccccggacagggaacctgtgtgggacttggccagctcctgcgacttgctggaacgtccggtctttaagaccaccaccggcttctttttaagggcagccttctggaaggcggcaaccagcttctcaggctttgtaacgccttccatataggccgccaccaccttggtgtcctcatcatccaccaggaaatccagataatcctccaccttcacattacatgaattgccggaggaaatcacatgggaaaagcccatgttaggactgtccagaccgcctaacacaatctggccgctctgggaaatcataccgatattgcccccgcgctcacgctcctccaccaggaaggcaaatgcaaagatcccgtccacgaaattggcgaagcccgcgcagttgggccccatgacggcaatgcccaggcggtcggctgcttccaccagctcccgctggcgctccctgccctccggccccacttcgccgtagccactggcaaatacaaccgcgccgccgcagtttttccccgctgcttcctccagcagcgggatgattgtcttctgcggggtgcacaaaataaccaggtccacatccccctctatctccgaaagggaatgataggcgcggcggccgaatatggtatcccttccaggattcacaaggtaaagctgatccaggtttttggagaatttaagatagttcctggtggtatcaccgccgaatccggccttttcgcttgcacccacaatcgcaatggttcttggttttaataattgattaagattcatgccgaaacccttcctcctgttccatttccactacagatcagccgattttccctgccttctcgtagcctgcctcaaagcactgcacgttcttctcactgggtatgcccttatggtcaaaataatccctcagcgtatcggagaactgctgtttatccatcatctgtgtggccgcaatcatggcgcccatcatgaccaggttggcgcccctggtattgttaaggtccgcggaaatacccatggcatccaccccgaacacctccacattggcaggatactccctgtcactgaacaatgacttgttaatgatgatcttggcgccgtccgctgcctggtcaatatatgtattatacgcatcctcgttcatgcacaccaggacatccagcgtatccggatagggactgccgatttcctcgtcggataccaccacgcggcaaagggcgatgccgccgcgcatttctgcggaatactcgctggtccagcttacattcttcccattctccgcagcaatctgtatcaaaatcttaccggctgtcaggacaccctgaccgccaattcctgcaaacattatatcagccatttgcttcacccccgttatttgtatggtccacgtataccttcaccggaaataccttttcattttcttccttcagtttcttcatcgattccaccggagtcatcttccagttggtcggacagggcgaaagcacctcgatgatggagaatcccttatcgttcatctggttctcgaatcccttttttatcatcttctttgtctcgttgatgtgctgggggtcatagagggcgccccgggcagcatattcgatgggatactggctgatgatgttcagcatgtcaaatggctggcctgcaacgcggtcatcccttcccttcttgctgctggtcgtcttatcccccaccagggtggtggcaaggcacatctgtcctcctgtcatgccgaagattccgttgttcaccacgatcatggtgatggggacattcctctgtgccgcaaaacacgtttctgaaagtccgattacataagaacatccgtcgcctgcgtgtacatatacattggcctccgggcgcaccttcttaatacctgtggcaacagcggcacagcgtccgtgggggcctgcgatgccatcgcagttcaaggtgtcgatggaccagtaggcacaggcaatatccacaacctgtacggttttctctacaattcccaattcctcgcagcattccgcaatcagcctctgaatgataccgtgtccgcagccgccgcaccagcccacctgctggttgatcatttccggttttgttaacttcacagccatattagtaaacctccagttccttttcttttccttcgagtacccgtttgcaatagtccacgattccctgtgtcttaggaacatacttggatgtcagataagcatatacaggcagggagaacctggaagccagacagagatcctggcccatctgtgcggacaggctcatctccacggaaacaagtcccttcacgctgtccggtaaatttttaaatgccatttccggataaggccatgcgctgatcaggcggatcaggccaagcttcacgccctgtgtcctggcgcggcggaccgctgatttacacaccctggaggagattccatatgccaccagcaccaggtcggcgtcatccaccatgaattcctcccagcgctgttcattgtcatgcatctccttaaacttatcccgcatcatggagtcatacgcttcataattcatggaccggtccagattggtcacctttacctttggttcatcttttgtcttgtatcccttgattgcccagtcaaacttatccttgtcgtgctcttttgcctcaggcagcaccaccttctcaatcatctggctgattccgccgtcgcttaagatgattacaaccgtgcggtacttctccgccaggtcaaaggccaggtatgtaaggtccgcgcactcctgtgccgaggcaggggtcaggacaatctgcctggaatccccgtgtccgcctccgcggaccgcctcccaataggaatcctgtccttcggtaatctcgccgtcgccgacgccgtatctcatgacatcaacaagaacagccggaaggttgtaggatgccagataagagattccttcctgtttcaggtcatatccagggccggaagaacttgtcatgaccctctcgccgcaggcagccgcgccccacagcatgctcatacttgcaatctcgctttccccctgaatgaataccccgccgcgggcagccatgttggctgacatatattccaggatctcactctgcggtgtaatcggataccctgcgtaaaagcggcatcccgcccgaagcgcggcctccgcaatcgcttcgtttcctttcataagcctaaatttttcacccatgtctcttctttcctcccctgctattctacggtactgatggtaaatacgtaatccggacaaattgtgtagcaacgtccacagccaatacaggtttcctcatgaatccggataatctcatagcccttcttgttaatctcctccagcggttcaatcgcctggaccggacaggcgcccacacagagccggcatcctttgcagagacttacatctgcgcttgcttttgcttttgccatttctacctcctattatttcgtttcactttttaatatattatttcattttttattttgtagtttcatattatcactatttatactatttttcaagtactattttaggtttattatggttaaatttcactaatctttttttgcttgcaaaagaccccagtttctcctataatagtaaataatagtgtaacgaccgtctcaaaatgcggctgttcactgctaaggaggatttataatgggagaagaaaccgtaaaaacagagaccatacaggccgtggacagggcattacagattctggaaaccatagggcgtgtgaacagtatgagtctggcagaattaaacagggaaatcaaagtaaataaggcgtccctttcacgccttgtctatacgcttgtacagaatggatatcttgcaaagaatgaaaaaagcggggaattttccctgactttaaaaacatatgaggtggggttgaatgcggtacagaacctggacaaactgtccctgatcaagtccaccctggtggacctgaacagccggtgcggccggattgcacagttttccgtggaagacaacaaccagctcctatgtctgcagagtatcggaaaggaagccatgtcattttcagtctacaccagcgtaggccaccgctccccgctctacagcaccagcgcgggcaaagccctgttatccgcttattccaatggggaaatcatagaaaagtgggacaagatgaacatccagtccctgacagagaatacattgacagacctgcagctgttcctgcaggatatcggattgacccgccagcgcggatacgcccttgaccgtgaggaaaatgaataccatgtattctgcgtgggcgccgttgtcatggacttctccaaccgtccaatcggcgccatcagcatcagcggcagcaccctcaccccccaggaagaacaggaggtaagcagcatgctgctctcttccagccgcaagctttccggtcttttggggtatgcggtgcggtaagggaggattgatctgcctttggccttgcgggagtttccatactctgatatgaatggatagggcggttagcgctgttaaaatatcataagggcaaaaaaacagggaacgggtcggcatttcgccgtcccgttccctgttttacacttattgctagtggacttatcaaaatataattatctgaaaatcccgtccgtggattcatggggactgctgatgcgaagggatgatccgctgtcacagcagacctcaatccgggcagacgatttacttaacatcccaatcatcatatcccgtcaggggatgacggaggatttccccaaatggcttggggaaaaacaggataaactgaacatagtggctacctatgatttgatttttaatgcatctgtcatggtaagggagggacttggctgtgcattgggttttgataagctgattcacacaggtgcggacagcggattgtgttttcgtccattggaacctggcctggtaacacctatgtatgttatctggaaaaagtatcaggtgtctacgcccattgcggagaaattacttgatgaattgatggggcggttttccgatgcaccgatgtctgagtgcctgttcccttccatttaaggagacagaaggacagccccttttgcgcttactgcccatgactgtccccagggtttcattcatatcccttttggtaacaggataaaaaataatcgataaataatttagtttttttgtcaagtttatcatgattttttgatattatccccagttcccaatacatcccttcatctgcaattggaatgcacaccagattttcatgtgcgctttcttcatacacatgctttacacacagcaaaatcccctgcttctgcgacgccattttcacaagctggcttacatccgatgatttatagataatatgcggggtaaagccagcctttttgcagctgtcctttgtcctgtaatgaatattataacggctgttaaagaacaaaaagtcctcatccgccaactggcttacatgtatctcctcctgtttggccagcgggtgttccctgtgggcaatgaagaacattttttcacgatgcagcgggctatattgtaatccctgatcatgccatggttttgtggacagggcaaaacgatggctgtccgcaagcacatattcttccatgtccaaatcgggaaattctacctgttccagcttcaaaccaggatatagcgtttcaaagtttaacagataattggcagacaggctccggaagaccccgggcgctacgccgatggttatggtcccttgctggattttaaaatattgatacgattccctgactgcttcctcataccctgcacacactgggaggaatttatgtttcagatataccccgctctttgataatttgattcccttactggtgcggaggaacagacgtgtattcagttccgattctaaatttttgattgatttacttaaagcctgctgggatataaacaattctttcgctgcctgggaaatacttgtgctttcagataatttcataaaatactggatctgtctgaattccattgctcttctccaccgtaatcttaagacgtgttcttgccgactcagctttagtttatcacaactatgagtgatggtaaatacaattctccggcatattccatgcatttcggggctgctttggggctgctttttggcacaactccaggttgtggcaatcacaaacactatgtgttgttaattagttaacaatactgctagaatagacttacatagaacatgattaaggaggaagtaacaaatgaaaaacagatactaccccaatttagcaagtcccatcacaatcaatggcgtcacatttaagaaccgcattttcggcgcgccgatgtcgaatccggaattggatccggattgccacatgagggaagaggatatcgcgtttcatgcaaaccgcggacgcggcggcttggccagcgtatgcattggtcttggtattgttgaagccgtaggacgctcacacacaaaagaagtaatcctttatgatgacctgtccctcccatccttaaagagaatggccaatgaattccataaacacaactgcatggctaccatggaattagcccatggcggaaagttcggggccgccagaagccactctgctgccaaaagcaccctgattgggccaaatgacgaattaaatgcccagggcgttcctgtaaaagccatgacggaagagcagattgaagagaccgccaccgcattcggcagcgcggccaggctggtaaaagaggctggttttgatatggtcttaatccatggcgggcatggatggctgttaggccagtttgcttctccatatttcaataagaggaccgaccgctggggcggaagcctggaaaaccgtatgcgtttttcactgcttgtcatcgagaaggtgcgtgaggcggtgggtccggacttcccaatcgaattccgtatgagcggttctgagtgtattcctggcggatatgatattgatgaagcagttgaaatggctaagatgattgacggaaaggtggatatcatccacgtatctgccggtatccatgagaataatgacgtatttgtaattacacatccttccatgttcactgagcatggatgcaatgtccaatatgctgctgaaatcaaaaaacatgtcaaaactccggttgctgcattgggcggcatcaacgatgtggatatgatggaggaaatcattgcttccggtaaagctgatatcattgaagtagcccgtcagtcccttgcagatccatatttcccggagaaagcattttccggacaaaaagacgatatcacacagtgctgccgctgctattcatgtttcttcaattacttatccaacaggaattactgctgcgcgtttaatccggtcattggagacgagcttgaacataaatatggcttcccggcaacaacgccgaaaaaggtcgtggttgtaggcggcgggccagggggcatggaggccgctgttacagccgcccaaaggggccactccgttacactttatgagaagaacagcaggcttggcggacagattgtacatgaacagcacatccccttcaaaaaggatatgtatcacttcattgaggtccttgctaagcgctgtgaggatgcaggcgtggacatccacttaaatacagaggttactcctgaggaagttgcggcaatgggtgcggatgtcgtgatgacagccgttggcgcgaaaccaatcattccgcagatcccgggaattaacagtgccaaggttgtgggcctgaaggcacttgagggcagacagccgtcagtgggacaaaaagtggcaatccttggcggaggcctggtgggttctgaagttgccatttatctggatatgattggaaaagacgtaacagttgtggaaatgaaggatacctgggcatctgacgcttattggatgcacaaggttgccatggacaaatatatccgtgacagcaggattgatatcaaggtaaacacaacagccagggaaattaccgacgctggcattgtatgcaacacgccggatggtgaaatcctcattgaagccgatacggtccttcttgccgcaggtatgaaagcggaccgcgcctctgcggatgaatttctcaatacggctccccgggtatttgaaatcggagacgccatcaaagccggacgcgtggttgaagcagtgaagcttggatactatagggcattggatatttagctgccagcaacctgaaaggaacgaaaatgatggacattcttgttacaattttcactgcctttgtttcaggcgtactggcaaccgccctgggcgcccttggttcagtaatccttacagcccttgtttccattgttggggtattctccattatggcgggatgcgaatataatatcatcgggaacatttgctttggaatgttcctggggccgcaggtagcctttgggccggccctctgcgcaatgaattatgcatggaaaaagggatacataaaggacagcaagggactggcccttccattgggatcattgcagaaaacagatgtattagtatttggcggtatctgcgcagtagcgggatggtacttgaatacagcccttggcaccttccttccgggactctttgactgcgttgcggcaaccattgtaatccttaatgtgattacaaaaatcatgtttgggaatgagggcctcatggggaaggttcctgagggagataagagatttggcttaaacagcaagaataagtggcttccccacatgacctatggccacggctccatgttctggctgttcggcggcagcgttggttttattgccgcatggctattgtatcagatgtgccgtttttctgaacaggtgggcaatcccatgattgcaggtatttcatttgtacccctttgggccattgcagtcgtgttcttaatcttcatgtgctgcggcctgccctgccctgtatttcaccatgtcgggcttgtgggcgcttacggcgcccagatggcatataatgccggatgttccgaaatcagtgtttacctgtggggctttgcatttggtatctttgcacattatgcaggcgatctgcttgcggatcttttctttgtatatggggaaggatatgttgacccgccgtcgctttccatgctcttctgctccgtatttgcatttgctgtctttccggcgcttggattggttaaccccgatagtgcggtttccgtcatcgcgcccatggccattatcctggcatttgggatctttgcatattttacagggaaatgcaaaaaggcagacgtgtcataggcagccagaggcagggctttgatgagggtcctgtccttgccgtatccgcattggacaataaccctctggtatgccacatgtaaaaggacacaccgtattatcgttgtgtccttttacagtccatgaaccggattcaataattaatcccttttacagccagcgccccatcggataccccgaatacaatattggggattccatcttttttaaggacaaatccggccatgctgggggaaagcgtctcccctccggcagcctccactgctgctgacagctccggtgtgaatatacggtctgttcccaaggcagccagctcttccggcgaacctgcccagacgcctccgtccttaaatcccacgtacagtggataggaggccagggaggacagggcgtccatgtttcggtccgcaacggcttcctttatttttccggcaaaagcagccacctcatcctcgggtaccaggaaattgtccgtatagccagttttccctgtcccctcccctgtttggcctatctcaaactccagttccccatatgcgccgggagcaatctcatatttgtcaaacacaatgaccggatttccattttcattcatataaaacctggtttcatccgtaattcccgtaaagcctccctctgacccggaccagaaggcaatgccgtccctttccttcatttcctccatctgccgcagtatgctgtcatccgcaatcctggcatagtcctggcccaggacatcttctagtgtaaccatcttataatccttcagatcaatgttgtagtatcttgtctcactgtaggccgtggaccagctctctgttcccagtactgcaaaggagagatattcttctgtctgggccttgatttcatatcctacacggattttaataccatgtgcctcccattcctcctcagtccctcccgtttccataaacgccttcttatattccctggcgcgttccactgcctcatctgcgtaccggctgcataaatcgtatatttcctgattcagggcagcatccagcccatccgtatcctcagctatcatctccacacttgggatttccacggatatcttccagtccccttcatccttttcataggaccggaaggtaaggatccgcgccgccgctcctatgacagggagtccggctgccatttccgcaaatgccgtatttgtatttaaggcagcagtaaatatcagcacaagggctgccgccgcaccggcacatgtcccccatatcctgttccttctgtgtatcccggccatccgtttcctttgctcctggcttcttctcttttcctctgattgggcaattgccgcctgaatccttccggacagttcaggcgggaccggtatcccttcatacttttttcttgcatcttccatacggctcatgaatccacctcctgtatattctgttttaacagtcttaagccacggtatagtcttgccttaaccgtattcaggtttgtgcttgtcacataagcgatttccttcagtgtcagctcctcaaaataccgaagttttataatggtctgcacatcctcatccaattggtttaactgtccgtatatatccggttcaccattatatccttcctcataatatggcacatcctgccctatcccgtcttctgtgggtatctccatcttctgtttcctgattaacagcaggctctcatttacaaggatgcggtaaaaccatgtcctgatggcattttcattcctgagcgccccgtagtggtccaatgccttgcagacagcactctggacaatatccattgcatcctcctggttatggacatagctgtaggccagcctgtaaaatttctcctgattgctgacaatatagtctacaatcctgttatataaatcttgattcatggggtacttaatccctccttacagtatgatttcatggtacatcacagcgtatatcgccatcactgatatatagattcttttttcctgccaaaagttgcatctgattatattttcctgtcataaaacaaggacaggaatcccttcgattcctgccctgtccggcagctgccccatattgccctgttcctgtctcatcccttttctacccggattgccgccatatgccctgttgcaatccgcttcatcggttttaccgagtacaggcagactgccatggtcagtatatctgccgccggctgtgccagataaatccccgttacccccagcatcccgggcaggattaatatgaacggtacatagaacaatccctgacggatgacggacaggaacagtccgtactttgaggagccaatggtctgaaacgttattgtcatcatgtagcacaatccaaatgcaggataaagggccacctgggaaaccagaagcctgaccccataatcaatgactgccggattcccgttaaacagcatgattaacggccttgccagaagtatataggttcccgctaccagtatggtaagaatcagggatgtccgtaacgcaaaacggaccgactcatgaaaccgttcctcctttttcgcgccaaaggaataggaagctaccggctgatatccctgcatgaaccccatgatcacatagcatccaatcagcaccaggcgctgcaccacgccgtatgccgctatgataagatctgagtccgccatgggcttcgccgcaatattcgtaagggatgttgccactgcaaggcagatctgtatgacggccgtaggtatcccgatgagcgtgacggatctgatgagcgtccattgggggttaaaatactccctctttatctttatgatggagcgtccggtgatatagaaccacccaaggatgaaacacgtgacgaactgtgaaaccgttgtggcaagggacgctccctccactcccatccccagtccccagctaaacatgaatacagggtccaggatcacgttaagggccgcgccggtcacaacggcaatggatgaaatccttacggatgactctgccctggccgcacagttcatactctgcgcaggaaggttggcaagggctgccacaaacatccagaatgcatactccctggcctggggcagcacagcctcggaggcaccgaaggaacgcaacaaagggtccatgaaaatgatgcctgccgcacataaaaggattccaatgaggaccgataaccccaccacggatgtgactgtcctgtttgcgccgtccctatcgcctgcccccagctgcctgcccgccaggaccgctgccccggccgcaaatatattttccaccgagaccatgatgagcagcagcggcagggtaacgcccactgccgcaagcgctatatccgaccccagcatcccgatataagccgtatccacaatgttgtagacagcctttgccagcagcgccagggtagccgggactgccagtctggtaatggccctggagggcttcatatcaccaagtatggattcctgctgtacatttccgttcttcatatccccacttccttccgctccaccacgccataaagcagcacatccaatgccctgcggcagtcctcttcatgtgtcttaaaatcaatctcctgctgcccggatgtctgatgctttgcattgacataatcctgaaactgcaggaatatatccaccaccgtttccctggataccccgtccctgagcttaagaggctccagtatccggttcaatatggatatattaaactcatcaaacccggacttacgctgtctgaccgcagcttccagatgggccggcggcatgatgaccgcctcgcagaaaatcctccggtacacgggaaatgtctggaaaaattcaaacctcgcatcaaaataaagctgcagctgtctgggaacggataccgcttccaatatcagcttcccctgcagatattctgtcaggacctggaaacattcatccacgcaggccagatacagttcgtccttggtctggaaatagtggtaaatgattcccttcgagattccctccccgctgcatatattgttaacggaactggctccatatccctgtcctgcaaactcctccagtgctgcctccataatcctgcgctttgtctgttggtttttctcttcccgtttcatgtgcttcctcccgaaaattattgacctagtggtctatttatcatcaggataccacaaattgaccataaggtcaatatttttccatatccaattaatttatgacatcgattcagtgcctgcaatacaaaagacgcccattccctgagcgtcttctacaatccggtcttgtccttacaggcatttcccgtctccaaaatgtcatgatccggcttcctgccgggagtatctcccatgccggcaaaggctgaccttaaaagaacggtgcccactcaccttctattttcctgcagccgtttatattccgtgatgtcggcgcaattaatcagatacgcatcgtgttcgccccatttcatcgtggagtaccgtatcctggtccatacatcatactgtgggttatatacctccgtggtgccggtcagcggacagctttcgcagggagtgctgcggccgaaaaacgcctgatggcaagtcatgccggccctggcggacggatccagacggagtgtcttttgattcacatacagcagctcataggtgccctgccggatgacgtagatataggcatcctgcatatccaggattgtgttgagctggaccatgatctgctcgttgcggtccgcctcccgctttttcaggaggaatgtattcatcatctgggcaatcaaagagagcatgccaatctcctctttgttccacatcctcagacccgtgcactcgtcaaacccgataaagccccggaattcctttccatcgtaaagcgcgcactggagcgtggaacagatttcctgactctcaaaaagcgcggtctgggtaggggtcagggaatggatatcccggcagtaaaaaatagagttatcccgaaacagctccttgtagccctccacgttttcataaggataatgctgtaaaaactccttttgcggcgcaattccctcattgcaccattcataagtattatcggtatattccccgctttcgctgttttcaaacacataagcccggctcacatcgaaccgccttcccacaatttccaggattgcttccacggcagtgtcaatatcattggtatcatacaggatttgaaacacataattgaccaggtccccaaccttcccacttacggtctggtcggaatcaatggccgcccccagggaggaatatccaatccggtccactgcctccagactattaacgtcatatcgggcatactggttcttgccctggcttttagcctggtacagtgccagatccgcacagtggtacagggtctggtaatcagtaccgtcccacggataaatggccagaccgatgctgcaggtcacctcaacgggctgtttttccccctggaacatctgctggaacatcgccagaagtttccctgccttctgttcagcaatccgtgtggaaggaatatcctttaagaacattgcgaactcgtccccgccgattctgccgattacatccgacttccgcgtcagctttttcatgccggctgccagttcagccagcactgcgtccccaaacagatgtccctgcctgtcgttcaccagcttgaagttatccacatcaatgatgaacatggcacataccgtctctggccggcctgacagatactgttctgccctgtgttccatttcggcatggttgtaaagaccggtcagggcgtccagctccgcccgcctgcgcagttcttccaccatccgcttttcttcgtcaatatctgaaatggtccctaccgcgcgcagcggcctgccgtctgcgtcatattgggtagcggcccgcagccggcaccagatatactgcccctttgtattgcggatacggacgtcaaggaccgaattggacaccccccgtttcacatcttccataagcgcggccatcggcccgatatcatcaggatagaaatgccgcaaaatttcctccttctggagtctgctgtcataattaggcgcataaccaaatttccccagccaattaggtgaaaaggaaatggcatcctcaataaggttccactcaaagatgatatccgaggattgattcatgatgatttccagatgctccaatgacagacgaagcttctcctgggcatcccgtacctcagtgaggtccagaaaaatacagaaaaagcgttcttcctgttcgtcaccgaacagctgggcgctgctggcagtccatttataactgccgtccttacacaagacccggtagctcagggaaagctggttgcctttattcagctggcgccccacttcacccaggaaattttgacggtccaatggatggatcattgtgaggaactgattttgaaacagcccctccagttcttccctggtaaatccgaatatactgaggaaaccatcgttgaccccaacaatggtgtattcattgtcattcctgcattgcatgactccacctggaatgaggttcaggatagcctcaccctcctgactgagccctttcagcaatctattcacatttattccccctcacaatcctggcaccccaatcgggagtgtcaatgaccggcgttcctctgcggtttctgccgatagtgatgctcctgctcctcgttttcggcagcccatcaatcgctcacatacatatatatttgcattgagtatagcaaaaaccataaaaaatagcaatagcctgtcctgctgcctgatacatcatacaggcaaggaaatagattccccaatcgtccgggattccccgaaaccaccataaaggaaatggctgcagcggcaaaggcctgcggttcaggagtgctgtagggcggcttctgtgcggctgttccgaaaagaaccgtctgtgggacgttaaccctgcttcagatattccttcctcatctgtcccggtgtctttccgtattgtttccggaaatactttgtataataactggcattatgaaaaccggatccatatgctatctccgtaattggaagccgtgtttctgtaagcagaaccgtgctctgcgcaagacggtatgtaataacgtaatcaatcggagaggtattcatatactttttaaatatattacagcatgccgtcttacccatctccccaattttcgcaatatcgtccagcatgatggaatcctgatagtgtttttggatatagccgaccattttccttaattgaatgagagaaatatcagctttctctgatttctctgaaagcagctccatattgttcgtatacaatagggtaaatatcctaaataccgcttcctggcacaaaagataaaactccggggcatcctgatccagatgaaagacggtccataacacttccagtaattcattctgccacttcttatccggacgtaaatgtaaaaacggaattgcctggcattctgtaaaagggcgcacataacgctccctgatatatggattaccggacaaaaccgagggatggatgatgaaacatatgaacccgcactcttctttcttatctgaatatccaaaatgaaagttccggctgtttaccacaatcccctcattctcataaagcgtgatgttttccccgtttacatcatactgcatggtgccggacaatacatatatgatttcaacatcctcatgccagtgtgataccgcagtataattgcggtactgcgataaaaacgcgcttcgtatatagacaggatactgtggaatcatataatccatcacttctgaaaaatcctgcttaacattgacctgcattgccatatagaacgtcccccgcgtttccttcccattaaggtgaaatatatttatattatttcgtaagattattatattattttctcttgttccgtaatataattataaaaacacagaaggaggatgtcaagatgaaggcaaatgccgtcatagaagactatcatgtacattcagcgtatagtgatgattccacttatcctctaagacaggtggtcatggattccattgatatgggaataaaagaaatatgctttacggatcatgtggattatggaatcaatcgggactgggacgatccccttggaatcggatacaggtcaggagccgccgggccggagccctttgcgaatgtggattatccgaagtatgcagatgaaatatccggcttacagaaagaatacggagaacacatatccatcaagctggggttggaatttggagttcaggtccacacaatccctctatacgaaaaactcttttcccgatatccttttgattttatcattctttcaatccatcaggtcggggataaggaattctggacacaggaattgcaaacgggacagacacaggatgaataccgatgaaaatgagaggaaaaacatactggatgaattacttccgacaagaggagagggggcatacttacagggacccatttattttgactatgggattcataccagccttgggaaaagtttctatgtcaattctaattttaccgtactggatgtctgccgcgtaacgattggggacaatgtgttcatcgggcccaatgtatccatttttaccccccatacatccgcttcgctggcaggaccggaatatgtatgtatcggaaaaggggacgatgacaaataaagagtatggcgcgcctgtaacgattggggacaactgctggattgcgggaaacgttacgattcttgccggctccaaaattggttccggctgtgtaatcggcgccggttccgttgtatccggagaaatccctgaccattcggtggcatatggcgtcccatgccgtgtcgcccgtgcggttacagatcatgatggtcttgaatatcacagggagctgttctaaccatataaaacttcttaaaaaaaagaagtcccctggtccactacccaaaccaggggacaagcgtcatctacttaacgccctcagcctcatcaatcgccttcccaatatcatgtctcatatacttattcccaaactcaatccactccgtagccctataagcattctccctggcttccttaagtgtcctgcccttggccgtaacccccagcacccgtccgccgttggtcacgatgttaccgtccttgtcaaacttactgcccgcatggaacacataatagccgtccctgccctcgaagttctcaaacccggtcatcttatatcccttttcataatgctccggatagcccgcggaagccagcaccacgcacacggcggcattgtcctcgaactccagctctatctggtccaaggtcccgtccacgcaggcctcgaatacgtcgatgatatcatttttcatccttggcagcactacctgtgtctcagggtcgccgaaacgtgcattatactccagcaccttaggccccttctccgtaagcatcaggccaaagaaaataatccccttaaactccctgccctctgccttcatggcgtccacggtgggctgatagatatgttccttacagaacgcgtccacttcctctgtataaaagggactgggtgaaaatgtccccattcccccggtattcagtccctggtccccgtcccctacccgcttgtggtcctgggccgaggtcatgatcttgatggtcttaccgtccacaaaagagagcacggatacctcccggcctgtcatgaattcctccaccacgatccggtccccggcggagccgaactgcttatctaacatcagggtcctgacgccttcctttgcctcttcccttgtgttgcagataagcacgcctttccccagcgcaagaccgtcggccttaagtacgatgggaatgggcgcatcctcaaggtatgccagggcctcttccggcgaatcaaatgtctcatatgcagccgtaggaatattatattttttcatcaggtccttggaaaatgccttggagccttcaagaatggccgcgtccttccttggcccgaacacccgcagcccggctgcctcaaaggcatccaccgcgcctgccgccagcgggtcatccggtcccacgattaccaggtcaatcccatgttccctggcaaaggctgcctgcgcgtcaaaatccatgaccccgatatccacgcactccgccaatccggcaatcccggcattgccaggagcacaatatatcttctccacctttggactctgcgccgccttccacgcaatcgcatgttcacgtccgccgccgcctacgattaatactttcatgccgttacctcctgcctgtttgtcctgtcatatcccgtcctataccaattgattcgcaatcatatggatggcctggggaaggattacccattccgcttcttccatcacccgtttctgcaatatctcaggcgtatcgcccttcttcacttccacggccttctgcaggatgatggggcctgtatccatgccgctgtccacataatgcacggttgcccctgtgacctttacgccccgggccaaagccgcttcatggaccttcagcccataataccccttcccgcagaaagaaggaatcagggacggatggatattgatgatgcgcccctcgtatttccttgtcatggcctcgggtatggccaccaggaatccggccagcacgatcagatccagatgatatgcgtccaccttggccagaaacgcctcattaaacgcatcccttgacccatagtcctttggggaaatgcacactgcctcgattcccctaagccgcgcccgctccagcgcataggcattggcattgttgctgatgaccacggccagttccgtgttggtaatcctgccgctgtccattgcgtccatgaccgcctgaagattggtgccgcctccggacaccatgacgcctatccttaacataagtccacacccttttcaccgctctcaatggagccgaccacatagggggcatcgcctgcggcccggatggcttccatggtcctgtccacatccgcggcgtccactgccaggatcataccaaggcccatgttgtatgtgttgtacatcatcttctcttcaatctgtcccttttcagccagcagcttaaagatgggaggcaccggatagctgtccttcttaatcaccgcacgcacgccgtccttcagcatgcggggaacattttcatagaaaccgccgccggtgatgtggctgcatgccttgatggtgacccctgcttccttgacggccttcagggccttcacatatatcttggtcggggcaatcagcgcctccccaagagtggttccaagaacatccatgtaggtgttcaacccctcttttgtcagttccttctcaaatacctttcggaccagtgaaaaaccattgctgtgcacgccggagcttgccattccgatcagcacgttcccggccgacaggttttcgccggtaatcagatccttcttatccacgatgcccaccgcaaacccggccaggtcgtattcgtcctccggatagaatccaggcatctcggccgtctccccgccaatcagcgccgcacctgactggttacagccctccgccacacccttcacgatggtcgcaatcttctccggcacatttttgccacaggcaatgtaatccaggaaaaacaacggctcgccgccagcacaggcaacatcgttcacgcacatggccacacagtcgatgcccaccgtatcatgcttatccatgaggaaagccagcttcagcttggttcccacaccgtccgtgcccgaaagcagggtgggttcctccatccccttgaatgcagccatggaaaatgcgcctgagaatccgccgattccgcctaatacttcaggacgcatggttcctttcacatattccttcatcagttcaaccgacttatatcctgcctcaatatcaactccggccttcttgtaatccatcatggttttatcatcctccgccttatttaaaaatccctgaatccctatttcatctgtgccagatattccttgtatccgatggattccagcttttcagccttcccgaccacgtcgttcttcaggctctctgaatactccttaagcctgcctaataaagcctcatcggaagtggccaggatcttggcagccaggatgcctgcgtttgccccaccgttaatcgcaaccgttgcaaccgggataccgcttggcatctggacaatggagtacagggaatccacgccgcccaggtcggaggtcttcatggggataccgatgacaggcatcgggaaaatggctgcgcacatgcccggaagatgggccgccttgcctgcccccgctatgattaccttgaatccctttccttcagccgcctttgcccagtcaaagaaaacatccggctccctgtgggcagatatgattgtcatctcgtagctgattcccagtttgtccagaatctcagccgcctttgccatgattggcatatcagagtcacttcccattacaattcctacttttgccatcgtccaatctccttttccacttaaatccatcgtctccccacctcaggaagcagaaatatcctgttattttagatagggatgtttattattagttattcttattaatttcttttattatacctttgttacttataattataatactaggaaatttttcatgagtcaatacaaatctacaaaattttctcccgatgaatgctgaaatgccggtacggcccatgtttccaggccctcccggcatttcgtatatgaaaatatggaaaaacagggctgtacgaccaactggatgtattcaggtaaaaagctccccggctgcttggatcatcctgatatctttcagcaattccgccttttgtccggaaaccggtttgtccacaaagacatcaaacaggttccgcggcctgtgtacagcgacaatggctgatgagcctgaaaaagtaaatgaaacccattttcctgatttgtccgcaaatgccttcattttctctattaacactggcgtcaatggggtatcatccccgtctgatgcataaacctggaacctgccgtcaaatcccggatctcctgttttaatcttatatgcggacgggcggtctttgaaccctgccacatatttattatcaaatacccgcatggtcccctggaagccaagcagggcagggacattgtcaaaacggatgaccggaccatggaatatggaatcggatgtgtatatcttccctaccttacctgtccttcccgtattcacattgcagagaaggaaccggatgtccccataatatccggtcagccggtccgtactggaaaaatggttttttacgccgcaatccaccacatgaagaccagccacttcgtcatagcccaggccgctttccgggaaatattcaagcgtttggaatctgccattttccatcaggaggggcaaaacatactgttccttataggccctgatgaagccttcctgtgcccgcctaatcagcagcagatagcaaaggcagcaaaaaataacggtcagcaatgcggttatgataagcgtgaataatccccactcgaacaatgtataatcctcattgtggattccatgacggccgaacatcataagcgatgccagaataaaacatccgcacagaaacatggcctttttatactgaccatatgcttttttcctaagtatttccagtcctttatcgtccatgggcgccgtcttcctttcctgtttatctgcatttccaaacatgccctgatatactttcagccgtttatattagcattttccgtctgtctgcatacgcacaggtacagcctggatacctgttttgaatactgctccatcagcctggacagccgttcctccccttccatggtccgtctataggccatggattccccggctgccggcacatggtctgcccgcatgtttaaccgcttctgtatgtcgctgatgatgcaggccgtgaatatgagataatcatccatctgttcattgtccatggaactgattttccggctgttaatcaggtacagcatctgctctgcctcggaaaccatgtaccaggaaatccagagcatttccctgatgaatccttccttctcatgtccggcttttttcaggtactcctgaatctggtcatggacaagatggtagtggatctggatatcgcagatgacgccgtagtccaggggcattttaaggctgcgtcccaacagcctgagatatacctggtgtatgtggagcagctggttcaggttataggtaaactggctctttaagctggtggggaaaaagaaccggttcgctgccagcaccatcaatatggcaatcaccacatataggaaccgcagctctgccgccagggtctgtggcagggccatggtggtaagcgtcagggcaaagcaggtggaaaaaagggcctgctgccatgttccggctgtctccatatacaggcccaccgccatgaccgtggccagcacaaaatgccatccggtcccatggaataagggcagaagcagctgcaggagcaggcatcctgccatggtgccgatgaaacgcgacttcatgcgggaggcgctgtcctcatacatggggcgcagcagcaggaacgcattcagcgcaagccagtagccgtgattggcctggctcatcatgctataggcaaaaccggctgtcaggaccacgctcagacgcagtgcgaagcgtgtttcaaaggtgtccgtcctcatgtggcagaataaccttcggaccgggcggcggtacaccggcagcttccagccaggtgacgggacattttcatctatcctgcgcagattctccaggataagaagcagaagcccaaggaagttgcgcacgaatatgtaaggtgcctcctccctgcccgctgcttcggcaaggagctcctttccctgttttgagaacgcttcgctgctgagtccgtccctgtatcctttgctgcatccgttcctgccgtctttgctgccgccctgctgaaagccttcctttcccatggtttccatataccgggcaaggcggaggaggatgccccggcagctttcatcagccagggttctttcctgatatggattggtaaggaaatagacagaccgctgaaacagcagcgcgaacatgtactggatcctgccgcgggcattgaccaccttggtcaggccccggcttttatacgcttccttgtaaagtccctgaaggatggggaacaggctgtctgccgacttttttccatcttcaggaacagggcctgcggcagattggagttcggccgcaagcagcagaagtcccttttccgccagggcgaaatcgtcccccttcctgcttctgcgtgaatggaaatataaaaccgctgtcattacagccagcccgtaagccaacgccgccatctgcatggccaggccctgccagccaaccgggcgcagctgcaggaatgtaaaacacatggccccggtatagtatcccagctggttaaactgcgaggactggaggaacacaagcaggaacggcacggtcaggttcaaaaggatgcagagcggcaggttcagggtcgcaaggaagctgagaaaggccatgaggaactgtgtcccaaccagccccataagctgcctggctgtcatatatctccggtaattgattttgaacagtatggtaaccactgacacaagaatcacatgtgaaatcccaaatatcagaataacagaatagaataagaacagaaaaaataatatgattggcaaagcttccataaacttggaacgaagccctgccaatcctgtctgcaatttgcttttcatggataaaaacctctccttcaggatttcattatacaactaaggccggaggatgtcatccatatatttatttatgactgagcgtcttccacctcattcacacaccgcagtgcattcagtgagcgtggatagccgatatagggcaggcactggctgatgacccggatcaggaactgtctgtcattgccaatccggatgttggcggccgcatggcttgccagctgcggtccgcatccgccctgggctgccaggaaacagaatgtcatcatctccctctgcctgtcatccagcccccttcttgtataataatccccaaagcagttatctgccagccatttgttgatatgcctggattcctccggccctgacagataaaagcctttcatatgggggccgaacaaatccacctgggcctggttacccttttccagccggtcctctttggtggtggttgccatggcttttaagggcagtccatatccttgtccctcaaggatttcatttgcagcggtcaggaacgggtatacccttccgattcccagataggcggttgcctggtacaggatttcctttacttccacaggcgtcaccccaaggttcagggcggcggggagcattaccttgaattcatccattccctggcaccccaggagggctgataagactgccatcatccttgtcctgtcatccatggaggcatgtttctcatggatgacctcgtccagcgcaaattcattgaaaagcgcggcaaattccgggtcgctctgctccaggccggatacaggggtgggggatatttccccgggatgtccgctttccatcgccggttccacacggcttttgcacattccatattcctcatccgacaccggtccgcaccattcattggaagccccctgggccgggacctcgattgccagatgggcaaaccagctgtccggggcagcgccgtgccagtgctttacctccggagggatgttcacgacatcccccggatgaagctcctgaggttcctttccccactcctgataatatccccggcccgcggtcaccaagaggatctgcccgcctttgtggtggatatgccagttgttccggcatcccggctcaaaggtcacattgcccactgccagcccttgcgtcgtaagcatgttaaggtaactctgtcctttaaaatacgctgcaaatgcttcattcttttccccaataggaaatacgcttaattttgaactatccatgacaacataccgcctttcattctatggaaccttccattctatggaaccttgccttccaggcattaccatccactccttaccttccaatccttgccttccagtccctatcttccaagcccggtcaggaattccactgtctccgggtcataatgggagaaaaatgcactctccttctcatccaatacctcaatggcctgcatatccccatcatccagcacaaagtcaaatacatccaggttctgttccatgcgttccctgtggacggacttggggattaccaccacatccctctggatcagataccgcagggcaatctgggccgctgtcttaccatgcttttcccctatctcattcaaaacaggattggtgaagaaatccttgcggccttcggcaaagggcccccaggattcatgctgcacatggtacctgtccataatgatgcgggcatcctcctgctggtggaacacatgggtttccacctggttcacggccggggccacctccacaaacctgcacaggtcgatgaggcggtccggataaaagttggatactccgattgcccggatatatcctgcccggcaggcttcctccatggcccggtatgtgccgtaataatcattaaacggctgatggattaacagcaggtcgatataatccgtccgaagctttctcatggattcctcaatggatgccttcgccttttcatatcctgcgttggatatccacacttttgttgtgaggaacagctcacttcgcggaatgccgcatttcatgatggcatttcccacgccttcttcattataataggcctgggccgtgtcaatggaccggtatcctgcgctgactgcatccagcacacagcgttcacattccgccggatttacctgatagacaccatagcccaggattggcattttgactccattattcagtgttacgtattccattctttttcctccttaaccactccctgattacctgttcctgccctgccgactgaatccttgtgccatgtattgccattcccggctccacaacagcgtccggacaaagcctgcgtatgtcctgttcactccgccccagcccgcttccctcatgggtgcagaacggccggatggttttcccggcaaatccgcaggtttcaagcaatgtgaacatgtgcatcggcatggttccccaataattaggatatccaagataaatcacatcatattgttccagatggtccggcatggccgcaatcccaggtctcgcatcctttttctggtcctggcgtgcttcctcaatgcacgtattgtaatcctccgcgtacggtaccacgggctggaccttaaacagtttcccgccagtcagcttctgtatggtttctgccgcaatttccgtatttccttttttcagatactgaagcgtaccgctgacgtaattctcgcctgcacgcgagaaataaataataagcgctgattccatggatttcacttcctttcagataccttcattatatccccaaagggattgacccggaatctccgatatgttaacatcgtattaactaaaagtttatatgaatacgcaaggacatggaggataaaaatgttcaatccacagctgactgcctttctctgcgctgctgactgcggcagtttcaacaaggcggcggaccagctttacatctcccccaccgcagtcatgaagcagatcaatgggctggagaagcatctgggccttgccctggtaaaaaggacgaatcagggcatcgaactgaccagggcaggggaatccatttacagggatgccagatatatgattgcctactcggaacaggccatccaaaaagcccggcagcttatgacagaggaacaggaggttctgcgcgtcggcacctccatgctcaatccgtgtaaggttttcatggatctgtggtaccggaccagcagccgcttcccccagtacaagctgcagattgtcccatttgaggatgaccatcagggaatcctgtccgtcattgaccggattggagacagctatgatttcattgtgggggtatgcgattctgcgaaatggctggaccggtgcagcttccttgcactgggggaatacaggaaaatgattgccgtccccttaaagcaccggctggccaagaaacactcccttagaatatccgatctgtacggtgaaaccatgatgatggtaaaacgcggcgactccgccctcaatgaccgcctcagggatgacctggagcagaaccacccccggatccggctggaagacactcctcagttttacgacatcgacgtatttaaccagtgcgtggaaaacaaccatctgcttctgaacctggaatgctggaaggacatacatccgtcactcataaccctgccggtggaatgggggtattccattccttatgggcttctctattcaaaaaaaccggagggctgcgtgaaagcgttcctggaggcagtgaaggatgaggggatgattggataatgagtttatgagataatggtgtgatgaggttatgaaatactgaggttatgaaataatgaggttatgggatagtgaggtcttggaatcaaggaggtcatagaatcaaggaaccgtagcggcaatcggttgaatatccttctgtccggcatagggcatatgagataaaaagtcagggcatgtttgaaaatatcattgaacattcatttttccctctgcatgcccacttttcaagaggcacagatgactaaaaatccgtttcaatgaaatcttcaaacatgccctaatctgtccaagcagttatgatacatcagaggttccccctgtcatcctccctgtcatcctccctgtcagattcacatatcagcgccactggttccccttccatggagtccagatatattcttccctttgcataaggaggataaggatactggtaaggatgccattttcccttcccgctgttttcaatacaccgcatcagcctgtctatggtctgcctgggaaaccattggttgtgatgggatgtcagataatagtcaaaatccaagtccttcacacatcccagcgtatggtactgtgtctcaaccggcatatggttctggaatatcaggcacatgacaggcgtaagggcatccccggacagcagtaaacggcgtttaggtatccatatgccgatggacccccttgagtgtcctctcaatggaatgaccctgcattccagcccgccaagattgaatgagtcaaaatccagcgctttcatattattccactgcttatcccattgcccggcttcaaaaggctggcagaagccatcctgtccaggggccagttcccgcctccactgcccaaggatttctgccgtataggattccaggatcacaaaatcgtccgggtgcatgtaaactgtgtcaaactggccatttcccccaatatggtcaaaatgtccatggctgttaatcacgacaaggggcagtcctgtaatcctgcgtatcagtccatggatatcatccgcgcctgaacccgtatcaaaaaccagggctttttccttacctatgacaagattcacacagcaccccgcccggtctgtcaaaacatatacatcatcacatatacaggtaacttctgtcttcttcaactgatacataatactctccatatgcagcacatgcaatcatgtattccttgaatctaaacgaatgtacgcccgaaagcagtcttgcgccttcggattcagtattgcctgcttcagtactccctggttctgtacgccttggttctgtacttcctggttctgtacttcctggttcagtactcccatccctggcatttccaggcgtaatcccttccgcaaacccggtcccctgaagttttaatgctgcctcgcactctgtccagtatttcgtaaacagttccggctgttccatttccccggcctgttccaactgttcctgctgttgtaaggtaaaaaccttccgcaccgtgggccagtggacgtcccttatctgttcaatatccacgcctatgtcaatgtccgccgcagccagcacagcatatcccccgctatgggacaggttaaaataatgctttcctgacttcagcgcgggtttcccatgccccagtctcaccatctgcccatcacggctgacatccagatacttttccagcagaaaaccggctgccagttcctggtcagcctcctgctttctctttattctccggtattgatccgcgtaatattgtgggatattgtcaattatttcctctgcgtgcaatgcaatccgtcctgcatctgcaatccttatcctgactaaatgcatatatactccttacatgccgtatgatattgaattacgcaaggcagtattatcttcatttctccaaagcttcctctctcctgccatctgcgcctccggtctgccctgcagcattccccgcagcgcctccacgcgccagcctgcgcacaagcattccctggaacgcatccacgcccacaccaacgtaaatcacgcccaccagcattgccacgccaatctggattggcagggtccctatttcattcactttcataggacccatgatggtaaggccgatggcccagccgcacagccaggagggagtgaagatcatccttgaaaatgtctcgccgatgatgactgccagtccgcccatgacgaatagtgtggcatacagttccacattgggattccactgcagggtttccatcacccatacggcaatataagcccataagtcacctaacaggaaaccgatggagattttcacggagtcctgccgtctgttaccgttggccacaaaaagcccggcgcagattaaggccaccgccccggtgccgactcctatgaaaggggccagcacagcccagatcggaggcatgaacgctatgccgaaagccagggtcagcatattgattgtcttccgttgtttttcatccatatttttttactcctatgcttttctttcccatgcactcattttccaggcccttccgtccccattactcccagtcaaacccatcccacacaggctttccggtatatgtcttcagctcctcctcgccttccagcacgcggattgccccggctgccatggcctccatctcaaactcgcccggataagcggtcacaggggcgatgaaggaacaggcatccgttatctgctttacaagatcctggttatgtaccatgccgccgcccagcaggatgccgtccacctgtccgtgaaggactgccgccatggcgccgatgcatttttcaatctggtatatcatgctgtcccagagaagtcctgcataccggtcccctgctttggcccgctccgtcagttcaatggcatcggaaatccccacatgattcacgaaaccgcctttgctggtacagagttttttcacatcttccagacccgcctggttcattttcatatattccagaaggtttgccacggaaatgcttccgcatctggttggggccatgggtccttctcctcccacaatatcatacccgtctatcatccttcccttttcatgggcggatatggaaatgccgccgccgatatggcataccacataactgcactccccatatggtttcttcatcacgtccttgctgtgccggatggcggtttccttcaggttcagggcatggaggtggatgatgcggtgtacgccccggatgcctgtcatgcgggcaaggtcctgaagctcatccacatccggcgggtttaccaccattgctttggcgccataggcctgtgcaaattcattggccagctgtgaacccagggccgccggatggatgacgccgttggcacatgtcctggcgtgctccagcatcaggtccgtcaccccgtaggttccgccttccatggcaatcaggcctccgccccgtcccacgaatacgtccacttcctcaagacgtatgcctgcttcctttaacagctttaaaaccgtgtccctgcggtagggcagctgctctgacatggatgcatactgcccaagctcttttgcctcatgggagacattctgggaatacaggcattcctccccctcaaagagggccaccttggttgaggtggagccagggttgattgtcagtactttatacggtttcatactggttcctcctgccttttacttcctgcggcccttactgcgctgattacgatatttcccttaatctcggacacaggggcgcctctggagcagtcgcacaccactttgttgaagccctggagcattgggccgtaggcatctgcgtgtccaaactgctgtatgagcttaacccctacattgcccacattcaggtccggccagataatcacattggcttttcccgcaacccggctctccctctgcacctttttagcagccactgccggcgatacggctgcgtcaaactggaattcaccgtcaatggcaagctccggcctctgctcattggcaatcctgaccgcctccgccactttatccaccagttccccctgtccgcttcccagggtggaatagctgaccatggcgcatctcggctcccagcccagcaggtccctgaccgtgtcgcaggcagaaacagcgattcctgccaactgccctgaatccgggttggcgcacacagcgctgtcgccgattgcaagaaggcttccttcacttcccttaaatcctgggatatcgcataacccgatgcttgagatggtgctgattcccggcttcagaccaatgatcatctgtccggccagcagcacatccccggttgtattgtcaatccccgcaaaggtcacatccgcctcgcccactgcctccatgaccatggcataatacagcggatcctgcatgcggcggttcagggccttttcttttaacagggtgtgcggcagggccacataccggtctatgagtttctttttataaatctcttccctgatatccacaattgtgaaaatatcttcctcatatcctttggaggataatgcttccctgatttcatcggcatatcccacaagcacgggaaggatatacccttccttgcctgtctcataggctgcctgcatcatcttttcattgactgcttccggaaatgctatcctctggggattttcctttgctttttcataaatctgttccagtaaacccatctctactcctttcggtcagattggctgaatccgtcctacatttccttttcaatcaggtccgtcaggtcgccgatagttgcgcaggcgctggcttctgaaagcatgatttccacgtccagttcattctcaatctcagacacaagggcaaccatctgcacggatgcgccgcccaagtcctccttaaaggatgtggatacggaaatgtcgctgatgtcctgtttgtatgacattgccaccatgttaagtacctgtgtttccaattcttttctgtccattttcattctccctctatgtttttattcgcagctgatccgtttcggattccatgtttttattcacgcttcgtccaagtcaaatacaacggtcttaaatccgccttccctctggaagattgccgcatggcagttcaggggaagcttttctgaaagttccttcctgttctttttgctgatgccacggacaactgcgtttaatttcgtgccttcctccaattcaacttccccgtacgcgtattttcccaactgcttatattccggtttggatgaaagggctgcaggcaatacaatggaatgcagcctggcctttccgctgatttcataccactctgtctcataattcccgcatgcattgcaggcatataccggggggaattccacattgccgcacttggggcatttgcgccctaagagtttcccttcttccagtccttcgtaaaatgtctgcacgaccttttctaatttaatactcataacgcatctctcctcctgctattcatccaataagccaagcaatacggccgcaacgttctgcgccccgccgtagccccggagcatggctgtcctgggctggtttttcacctggtgtccgccgcattcgccccacatctgcttgcaggcctcgtacacatccgccagacctgaggcggcatgggcatgtccaaaggaggtacggccgccattggtgttaatcggtttatccccatcccatgcggtgcggccctcacagatgtatttccagccttcaccgtaaggaagatatccggcaatctccgcggatacaagatgggatgtgatgatgaaatcatttgcatagaacaggtccaggtcatctcctgacaggccggtcagctcatatgcctggcgcacggcttcctcggttgcccggacttcaaaatgcggggtggttgcctcacaggcagcgcttccgattcccagcacctcaatgggacggtgcttcaggttccttgctatggccggaatcatttccgtggcgcatacaatggctgccgctgcgccgtcacattttaactcaatgccgccggcccggaggaaatcccccattttgggattatagggtgagttcatatattcatccagggtcatgcctgcttcttctgcaagggattcatatgtccttctttcaatggcaaggggattgaccgacgcgttgcgcctgttgttgatgcacatccagttcagtgtgtcgttcatctgctctggcgtgattcccctggtgcgcacataccactccgccgcatcgtcataaatcagttcctgcccggccatcaggctccttgtataggtgcggtcatataaccaggaagtggtctttaagaacttttccatggtcatcttatcccgcttgtatggatgtttggggctttccacattatcagctggggacggggtgctgtccccaaattcaaccgctccggtgaggacacagttgtatttcccggatgccactgcgttgaccgcctgctcaatggcaagataacctgtgcagcatgcctcggagtggtggatggaaccttttcccttcatcccgaaccagttagccacctgtacattgggcgtcagatagttggagccgttaagcgggctggcctcgccatggaaataaaaatccacatcctgaggattgacacctgcatcctccattgcttttaatgccgcatatccgaacatttccccttctgtcagtccatctgtctccggattatctaccgtgtacataaatggagtacagccaacgcctatgatagagacgcttctgttatactttcctaaagtgcccataaccatcttccttccttttgcttttttcaagattattatatataataaaaatgttggaatcatcgtgtccaaagctaactatgacttgcatcaccaccccatttttgtgcaggcgcacaatgccaaaggagacatcatggaatttcaggttttgttaaacaaactggaaaaaataaactaccgcccgctgatattcgggaaccaggacaataactgcgacatgctcaatataaggatcctgacagaagggcaaagccattttgaggaaaccatactctacttaacttccaccgggcttatgccggattccggcagcggccatccgtttatcctgttctgctatgggaaggcaattgacttttccctgtaccgggaaagttcttttaccattgtctattttggggctgacatttcccaggccgaactttttaatgtgaccctggagaacctgaccgagcttcagcagatcactgccggcatgcatatcctgaccaatgcgctgttttccgggaacgggcttcagtatctggttgatacggcctcccatatctttggcaatcccatctatgtggtggatcttcagaacaagtatcttgccatgtccgcgggaattgttccggatgacgattttttccgggaggaaagcgcgtccgggtatatcagtgaaaagggaatccgctccatccgggccaacaaagtggatgaaaaggtccggggggccgataccgcttattactttgtcaacagcctggtcaagaagggaatgctggtggatgcggtgcacatccagggcgtggaggttgggcatgtgatgatgctggagtccgaacaccccttcctcgagtatgacccggactttttccaccgtttctgtaagctggtgtccatggagctgcagaagaattcagcctattccaggaataaaggggtcatgtattcctacttcctggccgacctgctgaagaatccaaggcagaacgtgtccgatatcagggaacggcttaaaatccttggctacagcctcaaggaaacattttatatcgtggcaatcccgcctgtgggccacagcttttccgatttaaagctggaggtcatcctggagcatctgaagcagattttcgcgggcagtatctatgtgatttatgaggataccattgtgttccttatcagcagggccatggaccagaacctgagtgaatatgagatttcccagctttccggatatctcacagccaatagcctgaaggctgggatcagcaacttctaccagaacctggaggatacccccaggttctaccggcaggccattgattccgtccaccttggcctgaagcttaaggattccgcgccgatttattattacagtgattattatctgtaccagatgctggagctgtacgaaaaggaagattccgagatacgcttcctgatccatcccgggcttatgaagctttacctctatgaccaggaaaaaaatacggacttcatggccacactgagggaatacctgacacagcccggacagcctgctaaaattgcggaaaacctgcatatccataagaatacactgctgtaccggatggggaagatcaaggagattacggactgcgattttattgaaggggaggattttatgaattttaatctgtcggtgcggatcatgagatatctggggatgattgagtagggggagggttcatcatactgattgtccactgatttgattttatatatgattcatgatatgataatagggtattttcaaaagcggaaagaaataggatgcagatattgtgtgccctctagtatacgaaagagagggtgatgcccatgagcataatggaagttcttaccttacttctcgttatattcgcggcactgtcatacatagacaacaaacacaataaaaaatagcatcccaccgcctaaagtgaatgctattttttagccaaaactgagggcatcagattttgtatctgaatacctttctgccttgattatacactaggcacttgattttttcaagtgcctttttataaatgcagacattccgctttcagtcaatatccatacatcccccgcctaccgtctgcatgggaccggctttcttggacattttggctttaccaagccagcccttacgattgcgtcctcttcacacgcggacagacaggcgccgcattgggtgcattcgtcctgaaggatgatgtggacgaagcgggatttgccctggatggcgtcttcttcgcattcatccatgcagtccccgcagccggtgcatttgtcagccaggatgtgataggtcatgaattttttgcagaccccggctttacaggcctttttgccgatgtgcgcctcgaagtccgcggggtatgtctggatggcggccagcactgcctccgctatctcctcccctgtctcgcagagggattgggttttcatcatctgacacaggtccttcataaggtccaggtccccgctgcgcccctttttctccgtgatgtcgcccagggtaagctcaagctgggtgatgccttcgtaaccgaatacacatttcccacaggtctggcactggtttgccctgacttcctttaagaggatatctacgatacagtctgtctctttcaggttttttattctttccaatgtactcattgcggacacccccttaatattcattccacagctttggttttgtaagctggagccttaagtcgcactgaaggcatctggatgcctcgcacatggcctgctcacaggtgaacacttcttccacctgcgtaaagccctgtatcctctggtccggcggcgcggtccggggggatgtgcgcttttgtcctgcaaagccttccatccggccaatataggacggcggggtttccttatccagaagcatctcgcttatatcaccgtctccgcccagatacagatccatctgccctgctgccctgcgtcctgccgcgattgcctcaatcacggattttgtcccggtcacgacgtctcctgccgcatagacgccttccaggctggtccgctggttttcatctgccaggatatatgggccgtgggtcagttccagtcccatctgctccgtgtcctccggcctttgtccaaccgcgaatatgacatgatccaccggtattacctggttcgtcccctcctccagctcaatgaccgccttcctgttttcatcaaaataaaaacggttcaccttctggagttccactccctccacacggtctgtacccgtgatgcggaggaatgaatgggccgcgtggaggaggatgccttcttccgcgccttcagcgatttcctccggcgtggaggtcatctgctgttcattttccagacaggccacatgcacctcttccgcccccagacgaagggctgtcctggcgcagtcataggcaacgttgccgccgccaaggaccatgacccttccgcttacgggaagcggtgttccaagccttgcctgtttcaggaaatcggtattcacatatacctggggcaggccgcttccctcaaggggaagcctggttcctttgtgtgttcccactgccacgagtacggtgtcatatccctgtcccagaagctggtccggggatgggggctgtgtgtttgtccttaattcaattcccgcttccaggatggtattgatttccctgtccagcagctgatccgggagacggtaagccgggattccgtaccggcactggcctccggcctttgagttcttttcaaacacggtaacttcatgtcccttttttgccagataatatgcagcggtcagccccgccggaccggcgccgattacagccgccttctttccggtagccggttctttgcggacgcgttttttccatgcaccgctttcatttgcagccgcagcccgttttaacctgcacacggaaagaggggcgtccagttcattcctcttgcatccgctctcacaggcatgattgcagatacttcccagtgtctcgggaaatggtaccttttcgcggacaaccgctgccgctttgtcaaaatccccttccctgatataccgtatgtacctggggatatcgatatgggccgggcaggtgctttgacagggtacgatgttctctgccatggagcggttttccttcatgatcttcacctggtccatgatggaacccgtgggacagacctcgatgcatgccccgcagaaacggcatccggcttccttcagggtctttccctccggaatacctgcgcggacccctgcgtctgtcttaatataatccagcacctttacgccgcgaaggtcctgacaggcgcggatacatctcccgcagcggacgcatctggtgaacaggtgggatatcaggggattgctgtcgtcattagcaacacttctggatttcttcctccagcgctccgggctgacgcccatgtactggtacatggactggagttcgcatctgccatatttgggacagcccgtgcagtctgcggggtgggttgccaggatcagctccatggccattttcctgactttctccgcttccggaccgttgaccctgatattcatgccctcctctgccatggtttcacatgccgggaccgccccgctgccgccttcgatttccacggagcacaggcggcagcctcccttggcttcaaggtccggatggctgcagagatgggggatgaagatatcggcagccaaggcagcctcaagcacggactggcccttttttgcttctatttcttttccgtctattgtaatcttcattttttcactcctgtttcaggccaggtttccctggtatcagtactcaaacccatccagctccgccgccgcgttctcgcctgcaatgcgtccgctgttcaggcagaagcccatggtgttgcccgcaaggataaatggatagctgtctccgaaaatattgcatgcgtccgttcccacgcagtataatcccggaatcacctttgcctcctgggtcatggcctgtgtcctgtggttaatcttgacgccgcccagggagccgtatgcgcccacgttctggcggcagcagtagaacggcgcctttgcaatgggctgcatgtaatgcctgtctttttcaaatatctcgtcaaacccggcttcacacatctcattgtattcttccacctgggcggccagcccctcggggtcgattccagccttctgtgcaagttcctcaatggtatccgcctgtgttatgggttcatagccatctgccaggtccctctcccactgctcgtcaaaatggtcgtacaggtcatggggatgtacgtggcttacaatgtccggacctttctttttatactttttcagcagcttgctgtcaaagatggagaaggccacgctgcccggctgtgccgtgattgcattgcctgtgaaggtggtattgccgatctggtcctccggcatgaatctctggccgttgcggttcacccacagacatggctggcggaatgcgccgtccaggataaaatggttcatattatcaggaagctggtacataagttccattgtgcagggttccttgcctgcgccggcctcccatgccatgcgcagcccgtcccccttcatgccgggaatcgcaaagttgaaaatggtctttccgaactcatatcctgtttcttctttaatcatggccgggttgtccccaaagcctccagtggcaaggatgactgaattggcccttgcctcaatttcttccccgtccttgtcctttgccagcacgcccactgcgcggccgtcctccatgatgattttgtggaccggtgtctcaaggaggaattccacgcccagctccttggccctttccgtcattttcttggtcatggcagtggctgccctgggtcctggtatcccgccgccctcaggcttacacacatgccatgtgaactccccgtccgaataagcccttgtgtcctccggcgcgctgaacgccctctgcacgcctgcaaactccacgcccatgtccatcagccagtcaatggtgtcccctgatttgtagtaatagtcacggaccatcctggcatccacacgatagtgggtaaaatacatgtgcttgcggaacgcctcccccggtgtcagggaaatcatgtgctccctctggatcctggagccgaccccaagaggtcccattcccatgttggccgcgcccccggtggtgccggacttttcaaaaaccagtaccctggctccgttctctgccgctgatatggctgccgcaaggccggaaaggccggcagctgcaacaataatgtctgtttccatcttcttcatgtttcttcctccattttcttttatccctgttaatccgggcgtattacacaatgtcaatggcggcttcatatcccccatggattgcatcacctgcttttccggctttgtcacaatcaccgattacataggtcttaatgtccccggccatcttaagtatctcctgtaccgatgcctgatccgccttcattcccatggaatatatgcaggtatctgcgggaaccagctccgccctgccgtcccgttccaccacaacgccctctgccgtgaattccagaacctttgtatgtaacatctgcttcaggccccgtttgtccatctcgtccagaagggcgttcctatagtatccgaatgtctcaaaagccatcatctcctgcatctcaaccaccgttacctcatggccgcggcctgccaggtgaagccccacttcgcatcccacaagccctcctccggcgaggacaacccgcttcccaatcctgtccatatcatgatatgcctccagtgcattcatggcccggtcaattcccttgatgggcggtttgacaggatgggcgccaacggctatgatgacggcgtccggttttatctcatccaggatttccctggtacatgctgtttccatacggatatccgggcagctttcccttgcctcacggattaggagattcttaaaattcctcaggtccaccttatcctcatcctggtccgtgaaattaatcgtgccgcccagttcccctgtcttttccagaagcgtcaccctgtgtccccgctttgatgcggtaactgctgcctgaaggccgcccacaccgccgcccacaaccagcaccttcctgctttttgtgggatacggatgcctgtcttcataccatccaaacccggaatccgggttgatggcgcagcgccccatggacgccgggctgtaaatacggtcaacctcttccttggaaagccctttctcccaaagggggacatcggttttgtgctcacagaaaccagggtagcaggaaaagcatctgacacatttgcgtatatagtcttcccttcccgtaaatgccttgttggggaattccggatccgcaaagccctggcgtcccaattcgataaaatccgctttcccatccccaatcacctggtctgcaaaggccgggtcattgattccgccgatgacagccacctttgatttcgttactgccgccttgacctgtgcggcaaacccgacattgacgccgtgtacgtcaaagaaatccgaaaatgtctgggtctggttccccgcccatttaaggccgttggaaacgtggatgatgtcggccatcccatcgatttcccggcagaatcccaccatatcgcggatgtccatgccgccgtccacaccatcctcggccgacatgcgcagctccaggatcatgtcctccccaatcccttcccgcactgcctccaggatcattttggggaaccgggcgcggttctccatgcttccgccgaattcatcggtcctgtggttggtccagggggaaatgaactgttggatgttaaatccatgtcctccgtgaaccaggacgccgtcaaacccgcaggcctttgcgaatcttgatatcctgcggtaatcgttgcagattttttccatcatccccaggttcagcgcatatacctgcaccccgtcctcccggacataagcatccggcccccacggcacatatggggcttttgtttcagccacagcgccttcgtgggaaaactcaaggtaggcaagggcgccgtgctttttgatacggtccgcatattccttcacctttttgaagtcatccccgtcatagtcttccatgtcaatggcccgttccatgaacagtgtggttccctcttcattgtttaccggaagctcgcctgtggatacggcggcaaacccgccctttgcccggttctccaccatacggtatacattttcagctatctccggcagaaaaaacacggaatgcgcaaacaacgtgggggctgcgattaaacggtttttgtagacctttccccggatggtcatggggctttccagatgtgtgaatttactcatatgtcctcctttttcatctaaacctgaatggaacctggattccttattgtcctgtctggttcaaattataaaggattgacaatcccttaacatcatgcctgcaccttatgttttcttccatatgcagcttgtttttgtgcaaaggcacaaatccgcttcgcactaaacgcgtttaaactgtttgtttttatatttctgaagcctttcctgaaccagcttcagattctcaggatccgcatagaacccgccttcggtgtgaccgatttcctccaggtgtcttgcccttcccgccaccgtggtgcggtccttcaggtatccgtctttctggatgacgaatttccattttccatcccctgtcttttccagattgccgccggcgccgcagacctggcattccacgggatagtgaagcccgtcccactggggttcccccagaaccagggcattggaatggcagtttgggcaccagcccatatcctcatcccccagccaggtccgctcccctgccggtgtacggactgctgtcatgatgttttcacccatcttccttgcccgcgccatcaagccttcatccagcaggcactgtgcccgtcccggcacccttgcggccagtatcatgtccaccaccttcatatcggttgtgaacatggtggcctgcatggcctccagggccatggactgccacgcccttgtggaacctccggcacagatcagtcccgcaaccctgtccttatgctcaattgcaccgattgtctctaaaaatgcagtctcatagcttaagctcctctgggcaaatatcaggtactccgcattgggcatcagatcataggttggcgcggaaaaaataacggcgtcctgggccagcatgacctccatgattttctttttgtcatcctttgcatccagcacacagcccacattcttcccctgggccattcctcttgtacaggaagtacatcctgtacagctttcaatatgataatccttcagattgaccatggttacctctgcaccgtcctcctcacagtacataagcgcttcttttaacagtatctcgctgttgctgtcctttcttcctgcggtgatacccattacttttactgacattttctctcctcctggacttttgtctgaatcattttttctaacagatgttatggattagatgttacggatggatagtcggaattgaaacctgtccgcaaatctgctatactttatataaatatatcagttatttttttaacaatcatccattccaagtcggatataatccgcaatcatctgctgtttttcagacatttgtctgataggaggtttaacatggcatacttaggaaccattgtccgtcatctggaaaccacctttcatgtgaaggtacatgggcagttccatacacggactgaaattgaaggaacacgcttcctcacgcaaaaaccggaaacagacccggaccatggggacaagctgctttatatcgcatgttcccaggccgcggcccctgacaggcaccctgaggccgctctctccgctggggccacacaggccgccttccctgccgggcgccctgaggccgcggcgccttcctgccatctgccgaacatcctgctgaccgggcaggatacacccccggataacccccgcatcctctacatccaggaagccctggatgcctgcggggtattcaacgccatccaggaggtcatcttccggcattatacgctgaagctgaaacaggaggaattattccagtcactgcacagtgacaacgggattgacggtatggcccatgtggcccatacttttcttggcaaccctgtcactatctgtgataccagcttctcggtcattgccgccagcccggttgtgaaggatgcggacaacctggaggaaaagcacgggcgtctttacctgaaggattccctgttccagaacatggcggaccagaacatcatccggcacatctactcctccaccgtgccgtatagaaccaccctggacgattacccgtatcaatgggtatttgaaagcatacgcatccatcacgccgtggtgggctatatctgtgtccggggtacggtccgggaattcacggaagacgatatggaattcattgatgtgttttccaagatgctttccattgaaatgcagaaggattccagttaccgccatcccacgggactgagatacgagtacttcctcacggagcttctggaaggacattttgaccgggcagaatacattgccagccacctggtccagcttggacgcgcccagatgccttattacacaatcctgcttcttaaattcacggatccgtcgcgcaagccaaggcagtacaaaggatattttgaacagcttttgtcccttctcccaaactgcatggtggtattgttccacggcgacctggttgtcctcctgcccagcggcagcgggaatcccttccgtgaaacaggcaggaaccggtttgccgccttcctgcagctaaaccacatgcaggcttacgtcagctatccttacacggatattgcaaagagcagcatctattggcagcaggtaaaagagctgtccctgttccatgaaaaaaccggccttaaaaaagaccggcatttcatctattatgaacaatattatctggagcatggcttctgccagtataaggataccgggcttttggccgcctccgtccacccggtcatcacacagatgaccgcatatgaccgcaccaacaacacggaatacgccaggacactccgggtctaccttgcaaagaaccggaatgccctggctgctgccggggaactgcatatccataaaagcacctttttctacaggctggggaaaatggccgacctgttcggcattgacatgaatgacggcctggccctgttcagctatgaatactccttccgggcgctggattatctcggcatggggtgatgcagtccattccgtccctccgcccggtcaggctgtaaccgacaccccgtccccggatacccggacccagagggccggggcaggtccctgggaggcaaggtaatagtaagcactcctcttcccgatgccatggcatgcgtcatgccagatattccggtccaggaccgccacatcccccggattcaggataacggcccgcacatcttcggcccggggcggctcatcccccctggactttgccacgcaaagcacgaccgggtcagcggcgcagaacagcgcttcctgggtatggtcatgtttctccatggcctttacaacatagggcgcatccatgccgatggtataccccagctgccccggcgtatcgatgagcggcgtctttgtcatatagtcctcaaagtcctcccccagggtcctgtaaacccggtccctgtcccctgtcatattataatatgtaccgtatccggtaaaatcaaattccttaatatccactgctttcagtatcatacgctctcctttttaagctcgtttaagttggtcaggcacattaccacgattgtcaccacatagggcgccatcagcaccagctgggacggtatgttaaagctctgcaggcccacggaaagcgcgtccgcaaaggaaaagataaagcaggcaaaaaaggattttaaagggtcgcccttgccgatacgggccgcggacacagccaggaagccttttcccgcagacatgttctccgtgaacatggatatgccgctcagcggaaggaacgcgcccgctgcccccgccaggacgcctgtgatgataaggctggcccacttatactttaccacggacacccccgttgtctgcaccgccttgtcattaatcccaacgccccgcagacgcagcccgaagggcgtcctgtacatgacaatctgggaaaggatgaccactgcaaatgccatgtagaccaggatgttctggttattaaatatctcattcaccaccgggattccatccaggaagggcatgtggatgctgccaaagctcttgatccttggatccagtatggagcccctgatatggaatatattgaacagcagcagggaggtaagcccccaggagcttaggttcatggcaatgcccaccacgatggggtctgatttaaaatgcagcacaaaggttccgaaaacagcggacatgacaatccctgccgcgatgccgaacaaaagccccatgaacgcattctcaaacagatagctgccccaggtggcgaagaatgcgcttgtaagcacatagctctccagaccgatattgaatatctttgccttatggccgaacacactgcccattgcagccagggccaggggcgcggacagccggattgtggcggctaatgtggaaacactgaatagtaatttaaacataccttctacacctcccctttctggctgcgaagcatcctgatctggcgtttttcacacagccacttatacagggcctcatagtccacagccaccagcagtacgaatacagcctggagcacggagattaccagacggttggtattggtcaccctttccatgtggaaggaaccgctctttaacatcccccagaatatggaaatgaaaatgaccgcaatgggattgttcttggcaatggacgcaatcatgacgccgtcccagcccagattggtggcaaacgcaggcctgaacttgccaaaggagccggtcatctcggttccgccgcagacgcctgcgatgaatccgctcagcaggaaaatcaggatgaaggtcctcttatagttaataccgccgtatttggagaacctcaggttttcccccaccatctttagctcatatccctttaccgtatatttatacagaagatacaccaggatggcgattccaagggcaatgaaaatagcggtgctggcgctggtcttaggtatgatggtgccaaggcgcgcagtgggaagcatgtccggcgtggcaatggcgtccgccagttcagaagcgtcaaaccccatgtatttgaaggtcaggtactccgtaaacagggaggccgcatagtttaacatcagggtacagatcagttcattcacattcagcgtcagctttaggattgcgggtatgaatgcaaacagcatgccgccgatcccggcagccgccagacacagcggtatgtgtatgattttcggtaccgcaacggacgccccgatgatagctgcgaggaatgcgccgaaatacatctgcccttcaatccccacgttccagattccggacttgaatgcaatcacggccgcaattcctgttatgatgctgggggttgcccagcggatggttgtcccgatggcgctgacgcttcccacggaacctgtaatcagggctgaaaatgcctctgtgggactgtttccctgggaaagtatgatacaggtgccgatgaacatgaccatcagcatggataagatgtatttcaggatttccagcttggtattctgtgccagtctaaatttcatccctcttccctcctaacatgtacagtcctatggtcttctcgtccaggtccggcgtattttccaggttccccacgatctcgccgttatacatgaccaggatccggtcggaaagctccatcacctcgcccagctcatggcttaccaaaagcacggaaacacctttctgggcaatatcgatgattttctgccagatgaactctatggcgcccacatcaatgcccctggtggggtcctctataatcagcaggtcattgtcctgaaggaactcacgtcccacaatggccttctggatattgccgcccgacagggtgcccatcttgtcatggataccctgggtctttacctggaactgttccaccacttccctggtaaatttctcagcttcctttttattcacaagaaggggattcctgaacctgtgggccacgtgataacccatgatgcagttttccaccaggctgcagttcgtactgcatcccgtggccagacggtcctggggcacatatccgattttcttttcccgtttctcctttggcgttgcaaaggttatgtcttcgcctttatatgtaatcgttccggttttcggcttcctaagcccaaagaccgcctctatcagttcaccctgtccagagccggcaacacctgcgattcccacgatttcgccttttttcactgacagacccacgttctttactttctcaatcccatcgcttcccacaacagtcagcccttttacgtcaagcaccgtgctgcctgtatctttttcatgcttactggtattgaacagtacctggcgccccaccataaggcttgccagcccatgctcgtccgtatcctgcggatagaggttcccggtcacctcgccattcttcaggaccgtgatgtaatccgatatctccattacttccttaagcttatgggtaatcaggataacggtctttccgtgctttgtcaggtaacggattgcctggaacagcccctcgataccctggggcgtcagcacggctgttggctcatccagaatgataagttccgcacccttatacagtatctttacaatctcaacctgctggaggagggacacgggaaggtcctcggcccgttcatccagagggatggaaaaaccatacttctgcgcaatctcctcaatatcttttttggcagtcttcttatccaggaatcctcctgccttctttgtctcaaatcccatcatcaggttttccaacaccgtaagctccgggaacagcatgaattcctggtgtaccataccaatcccgcacctggtggcatcattgggattcctgaacacttccttcctgccctttacaaagatttcccctttgctgggtttatagatacctgaaatcatattcatcagcgtacttttgccagctccattttccccgatgatggagtgcacggtacctttttttacagtcaggctgatgtcattgtttgccaccagctgcccaaagtactttgaaatgtgtcttacctcaaggataacttcatccataagatccctcccttttaaggaattccccggcagcaaggtaaactgccggagaatgttcctgcccccctgccggggcgtaagccgtgccagggtatgccttaagtcccctagttagcggtgtcctttgtcacgtcaatggtgcctgcctttatctcatcccccactgttttcactgtttcctgaagttccggggacagcttgtcaaattcctgctgggtatacatcggaagatcctgggccattccgtattccttgtccccgccttcaaaggttccctcaaaggatgcttttccttctttatacagggcttcatcaatgggctttaaggcggaccagatgacgctctttccaacatcgccctgataatcgtcgctgccgatacattttacattcagctcatcacagcccgcaatcacgccaaggccgcttctggaagcagactggaagattaagtcaacgccttcgttctggatcatcagcttggcaacctcctgtcccttaacaggatcctggtcattgcccacataagcaacggatacctggatggacgggtctatatagtggaccccatggataaagccatccctgtacttgcggctgaccggacggtctgcatgggcaatgaagccgacctttttcttttccgtattattggccgcaaccacgccggcgataaaggaggactcggacgggtcaacggataccgagcttacattaggttcattggtttccatgtatacgtcgcacaggacaaaatccgtatccttgtattcaggcgcaagcctcagtgcgatttccgaaaggtcgccccacatggtatagacagggttataccccatgtccgccatggcgcgcacctggtcctcatactcggccttgtccagtgtctccacaatctttaattctgctccctcttcatctgccaggcgctgcaggcccttgacacaaagggcaatgaacgggtcccccacaggtgacgggatcagaaggccaatcacctttttcccatcgcttttttcttcctctgccttggtttcctccgcagccgcatctgtttccggcgccttggcagacgcgtcctgttttgtgtccgtctgccctgctgcggctgtcccgctttgcccagtctgtgccgtcttcccacagccggccagtacggttgataaccccagtgcaacacacaatgtaaccgctgctaatttcttcactctcataatcgttccttcccttctcatggtttaattatatttcagaatggcttcggtggtctttttggataatgacgttatggactggctctccatggtcctcacataggtatccagctggtccctgaggggagcgacaaatttatcatccagtgcatccagtccaagcattaccccatacgcatgtcctatggggccgcccgtacagtcattatcctgaccggccatcatcaatatcgtcatggcgcgctcaaagctgttgcccgcaaaacggattgccacaacctctgcagccaggttggggtacgcatgtacccagttgtattccttatacttttcctcacacagttcccatgcctggcggtaatccctggactgactgcaggcctggcatgcaaatgcgaggacgctgtagaattcactgtcacgcgggatcatccgcatggccttgtcaaggattacctgcatgtcggtttccacataagccatggaaacaatcaatgcgttaaacacttctgccaggatgccgttgttgtgatgggaaacacacccgtccctccacgccagctctgccgccatccttgggtttcccggcgccagggcgccgcagatggcggcgcgcatggcggccccgatcatctcccggtatgggttggccacataaccgctttccggcggatagatgccgtggcgcagatggttcagcgcaatctcctccgcagtataggcaaatggaatataccccacccatttatccgcgatatcctccgaggttatgtcataccccttttcccggaacgcttccaaaagggccagttcaaatgtaatgtcatcgttcagggtttccggcggtttcacatattccgttatttcgccgaatacctcccatatcctggaggatttaaacccttccactgcggttcccagggcggagccaatgatttcccccagccatcctgcatggaccttctcaaagagcgcatcctgtccgggcagcctgtattccgggtattcctggaacttcacggactgcgcgtactgttcaaagctgttgtaaaccgtgtaggaccagtaggggtggctttctatcttcggcgcctctgccagggctttaaatacccgggcattgatgatctgcaggtctatgagcctgtcctcatcaatggccctgaatgcttccggtatcaggcggtctgcttcctgtacatcgtatcccatgttcctcatactggaaatcgcacccagcatcttggagtagggcgccttggattccggcagcggcttaatccacgcccctttgccggtttccagcatctgccttgcctcctccaggaattttccctccaggaggttgtcccactggatcagatccgtgcggtccctgaccggaattgcgtcacagaaaaattcatagtcatattcccatgctcgtttcataatattttctccttatattcatatttttttgtctgttctgcacaatggttttatataattcttcgttccccccacacatgtatgcttatcctatcttttagtataattttagataatactgtcagcagacaatgaaaggagtaacaacaatggctatttactgtgaagatctgtttaaactgtccaccttccgcgacgcgcggttaaggggaggcaggaccggcctggggaggaaaatcacctggccttacgtaggcaccacccccagcgtatcccaatggctccacggaggtgaaatcctcttcctgacaggggtaggcatcccctcggacgatgaatccctgctgaacctgaccgaggaatgcatccagaaaaacttatccggcatcgtattcctgctcaatccggattacattcccgaaatccctgaaaaggtgattgaaaaagcggaccaggaagggcttcccgtgttccagatgccctggaacgtgaagctgattgacgccacccgggaaatcattgaactgatggaacaagtcaatgagaaaagcaagaacgtccgtttcttccttgaaagcctgcttttttccaacaacagcgatattgactccatcatgcatttttataacatccgccttcattcccagtactgtatatgcgtggtggaatccgccgacaatgtattctcagaagccattgaatccaacttccagcacctgtctgcctctgtgcggaacattgccctgtcaagccgcctggccatactcagctgttcctatgccaaccggctgatcttccttttgacggccgacagcagaagcgataccgtctatctgcagaacaccatatcgaataacttcgaatacatccaggcgcttcatgcatccaggggaggttatatgaaaatggctttcagccgcacctttaccaagctgaaccagatcaaacaatgctaccatgaaatcacggtggccctgtccaccaaaaacctccacgcactgtttcccaaccacatcatccactacgaaaacctgggaatctaccgcatcctgtttgaacttgataagaatgagtccatccgggattactgcattaagaacatcgaacccctgattacatatgacacacagcattcatccaatcttcttgagacactccggctttatttcatcaacaactgccattccagccagaccgcccaggccctgttcatccacaagaacacccttgtttaccgtttatccctgataaaggaacttcttcacacggatttatccaatgcgcttaaaaacctggagctgttcaacagcatcctcctgtacgattaccttcatgccgtctagcagaattcccgtctaacagaattcccgtctgatgaaatcactgatattggaaaccacatcctccacaatccactgccccttcagggcagaggaggatctggccgtggccagcaccccgttggacggtatgctgtttttatcaatgggataccggtagcagaatcccgggtccacatgatccacgtctgcaatcaggtcctgacgcaccagttccggcgcaaagtacatcatcagggaggtttccgtaatggcagcatgctccagcgcccagcccgggaatggcacctggtcaaatatccgttcaatcatattggttgacatggggtcccaccagttcatcaaaagaagctttaccccatccccatgcctggctgaacacaggtccatggcctccactacaaatggttcattctcaaaatgcgcattgaacagcaggattcggctgaacccatcccttacaaactcgtcaatcacatcctgcaccaggttctgcagcgtctgtccgttcaggtcaattgttccgggaaacagagggcctcctccgctgaagggcttcgatttatatccataacagagggccggggccacaatcccatccacctgtcctgcgatgcggtatgaaaattcctccgccagcaccgtatccacacacaggggaagatgcggcccgtgctgttccgttgccccgataggaaggatcacgatgccatcctttctccccgcatattccgtccatgtcatttccttcatcttgatgtgtcctgacatcattttgtccctccctttgtctcatctttgtatcatgccactatcatactgtttttcccctgtccttttaaggtgtggtccgcacaaaaatacaggccatgctttaggcccgacgcacacaaaagaaccggggattttttggtcctttggcacaattacttttttatccttttcctgtaatgtggtcttagagcatgtttgaaaactcatatggagggaatgaatcaattgaatacaatcttgtttaccaatgcgcatctttatcatgagccggatttatgcgacctgctggtggaggacggccgtttcctggaaatcgggccatgcctgaataaaaaatatcctgtggggaatatctgcgaccttcacggaaagctggtgcttcctccgtttgtggattcccacatccatctggattacgtatacactgccagggaaccgggggcgggcaactattccgggaccctctttgaggggattgaacggtggtcccgcggaaaacagaaccgttccgtggaggaaataaaaagacgggccagaatcgcgttaaaaaaggagatactgaacggaacccagtacatgaggacccatgtggatgtcacggatccgtcccttaacgggctaaaggccatcctggagctgcgggacgaactgaagggggtgctggaccttcaggtcatagcatttccccaggaagggatgtattcatataccaacggcgataagctggtggaagaagccctgatcatgggggctgacgtggtgggcgccatcccccactatgaatttgccagggaatggggcgaacagtccattaagacggtcatccggctggcccttaaatatgacaagctgattgacatccactgtgacgagacagacgacgagcagtcacggttcattgaatccctggcagccctggcctaccagaacgggatcggcagccgtacgactgccagccacgcctgcgccatgggttcctataacaatgcatatgtctataagctctttaagctcctagagcgttccggcatcaacataatctcctgccccaccgagaacatccatctccagggccggtatgactcctatccaaaacgccgcggcctgacccgtgtcaaggaactgagcgatgcaggaatcaacgtatgctttgcccaggactccatctccgacccatggtatcctttgggcaacggcaatctcatgaccatcctggactttggcctgcacatctgccacctgatgtcatttcctgaaatagaaaacagcttccgctacatcacggacaatggcgcccgcaccctgtccatggaaggaagctatgggatacggccgggcaatgacgccaacttcattgtgctggacgcctccgatccctatgaagccatctgcgaacgggtcggcgtcctggcatccgtgcgcaggggcagcttcctgttccgtaaacagcctgccaaaaccgaactcaactgcggttttctcagcaaagtgcaggatgtataagcggaaacacatggatgcgttcacatttattggcaataatgtacgaggatggcgccattatttttatgcatattgcacaagcattttcaaatattttttagaattttgcctatggactaaaatttttttaggtattataatataccacatgaaaacaatttaacatatccattgccaatatgtatatcctggggattggcccagagtctctaccaactaccttaaagagttgactacatatcttatgtagccagctctttttttgtttgtgtaagggcatttctgaatattccggtatatcttttggcaaaaacaatacaaggaggaaaatagaataatgaatattgtagggcagcaagtgaaacgtgttgatgcttacggaaaggtgacgggtgaagccaaatatacggcggacctggaacccagggacatccttcacggcagggtcgtgcactccaccatagccaacgggcgggtcaaaagctttgatctgacggaggcttacaaagtgccgggcgtggttaagattgtcacctgttttgacgtacccgactgccagttccccacagcaggacacccctggagcgtggaaaccaaacaccaggatatctgcgaccgcaaggtgctgaatgaacgcgtccggctgtacggggatgatattgccgctgttgtggcggaggacgaggtcgcggctttccaggcggcgcgtttaatcaaggtggactatgaagaatatgagcccattgtcacggttgaggcagccatggcagagggcgccacaccgctgcacccggatatcaggaaagacaacgtgatcgtgcactcccatatgaccatgggggacagcagttttacatatgaagaggggcttaaaaaggccgtggaaacctatggcgctgacaatattgtttccatggatgtggagtacgataccccccgtatctcccactgccatatcgaacttcctgtttcatgggcctatgtggacaccaacggtaaggtcaccgtcatctcctccacccagatcccgcacattgtcaggagatgtacggcccaggcccttggcattcccatcggcagggtgcgcatcatcaagccgtatatcggcggaggctttggcaacaagcaggatgtgctctacgagccgttaaatgcattccttaccctctccgtgggcggacggcccgtgagactggaaatcagccgggaggaaaccatttccggaacacgcacccgacacgccataaagggtatatgcaggggcgttgtgtccagggacggacgcgtgcttgccaggaaactggaggcttatgccaacaacggcggctatgcctcccacggccatgcaatctgcgccaactgcggcaatgtgttcaaggatttatacagggatgagtttggcaccgaggtggactgtttcaccgtatatacctcctctcccacggccggggccatgagggcctacggcatcccccaggcagactggttcgcggaatgcctgaatgacgacatggcctatgccattggcatggacccctgcgaattccggcttaagaactgtatggaggatggattcgtggatccggccaacggcatcaccttccactcctacggattaaaacagtgtatcgaggtcggcaggaagcacatccgctgggacgaaaaatggagcgcatacaggaaccagacaggacctgtccgcaagggcgtgggcatggcaatcttctgctacaagacaggcgtgcatcccatttccctggaaacagcttccacccgcatggtattaaaccaggacggctccatgcagctgtgcatgggcgccacggaaatcggccagggcgcggataccgtgttctcccagatggcggcggaaaccaccggcatttcctttgataaggtgtatatcgtatccacacaggacacggacatcaccccctttgatacaggcgcctatgcatcccgccagacctatgtgtccggcatggcctgtaagaaatgcggggaagagttccgccacaagatcctggaatacgctgcatatatgctgaaccacgatgtaaccgacctgtcaaggaccgtgtatgccgaagaggtaaaggctgccgggatgcggatcagggaagcccttggcctccacgaaggcgaggagattaccgaggacatgctggacatcgctgacagcaaggtcatcgtaagcggcggcgcaccggaattatttgacgtgtccgtggtggcggatactgccttctactccctggaccgctccgtacatatcacggcggaagtgaccaaccagtgcaaggacaacaccttctcctccggctgctgtttcgtggagattgaggtggatatgcccctggggctggtgactgtgacggatatcgtcaatgtccatgattcaggaatcctgatcaacccccagacagcccgcgcccaggttcacggcggcatgagcatgggactgggatacggtctttcagaggaacttctggtggatgagaaaacaggacgcccgttaaacaacaaccttctggattacaagatacccactgccatggatacgccggacctgaatgtggagttcatccagttagaggaccccaccggcccttacggcaacaaatccctgggcgagccgcctgccataccggtcgctcccgccatccgcaatgcaatcttaaatgcaaccggggtccacatgaacgtgacacctatgacagcccagaggctgattgagaaattcaaggaaaaaggtctgatataaagaggaccggtataaggagagagccatgtttgacattaaatcattttatgaggccgtaagcgtgaaagacgcaatccaggcccttgtgaaggatacggatgccgaaatcatcagcggcggcaccgacgtattaatccgcgtgcgggaaggtaaggatgccggacgttccctggtatccatccacaacctggaggaattaaagggcgtgaagcttcttgaggacggcaatctgtggattggcgccgggacgtccttttcccatatcaccaatgacccgctgattaaagaatacatccccatgctgggggatgccgtggacatggtcggcggcccacagatacgcaacaccggtaccatcggcgggaatatctgcaacggcgcaacctctgccgattccgcgtccaccatgtggaccctggaagcggacgtggtcctggaagggccggaaggtgagcgcaccgtgcctgtatgtgaattttacaccgggcccggacggacggtacgagaccgctgcgaggtctgtaaaggttttgtgatccgccgtgaaagcttcgagggctggaccggacactacatcaagtacggcaaacgtaaggccatggagatagccaccctgggatgcgccgtaagggtaaagctgtcccctgataagaaacggattgaggatgtacggctgggctatggcgtggccggtcccaccccccttcgctgcctcaaggcggaagaaggccttaggggccatgacatcaataacagcgacgccatccttgcctttggaaaggatgcgcttacgcaggtcaatccgcgtacctcatggagggcttccaaggaattcaggcttcagctgattgaagagctgtccaagcgcgcgctgaaagaggcaattaaaaaggcaggaggagagatagatgcttaaaatcgtacacatgaaggtaaacggaaaggatgtggagctggcagtggacgaacgggagtccctgttagacacactgcgccagcgtctggggcttacatccgtcaagaagggctgcgaggtcggggaatgcggcgcctgcaccgtactggtaaacggggaagccattgacagctgcatctatatgacactttgggcagaaggcaaaagcgtcatgaccgtggaaggattaaaggggccaaacggggaactgtcccccatccagaaggcattcatcgaggaggctgcggtacagtgcggtttctgtacgcccggccttatcatgagcgcggtggaaatcgtggggaccggcaagaagtataacagggaagaactgaagaagctgatttccggccatctgtgcaggtgcacgggatatgaaaatatcctgaacgcaatggaacggattgtggaagaggtatatcagatcagccataagacggagtcttaagggattgcccgcgcggcaccagatcctaaaaaataacagggggtaacaaaatcatgaacagcaatgcaaattgcagcattaataatatttataagctggagggacgggtgccgcttggcaaagccatccccttcggcctgcagcatattctggcaatgttcgtttccaaccttgcgccgattaccatcatcgcaggcgctgcacagcccgcattaacccaggcccagacagccatcctgcttcagaacgccatgttcgttgcaggaatcgccacactggtccagctctatccggtctggaggatcggttccaggcttccggtggtcatgggcgtcagcttcacctttgtcacggtcctcagcaccattgccgccaattacgggtatccatccgtggtgggcgctgtgctgatcggcggtatctttgaagggaccctgggacttctggccaaatactggcgtaagatcatcaccccggttgttgccgcttccgtcgtgacagccattggattctctctttttacggtcggcgcccggtcctttggcggcggttatgcagaggacttcggctctgcccagaacctgatcctcggcacgctgacgctgctcacctgccttttgtggaacattttcgcaaaaggatatttaaaacagctttccgtcctggccgggctgattgtgggatatgtgattgccattttcctgggcaaggtggatttaagcctgatcatgtccggcggcatcattgcccttccctccctgcttccctttgttcctgagttccatgcaggggcaatcatctctgcctgcatcattttcctggtgtccgcggcagagaccatcggcgacacatccgcccttgtatccggcggcctgaaccgtgaaatcaccggaaaggaaatctccggttcccttgcctgcgacggatactgttccgctgtctccaccctgttcggatgtcctccggtcacctccttctcacagaacgtgggactgattgcaatgacaaaagtagttaaccgcttcaccatcatgacaggagcggcctgtatgatcctggccgggctgcttcctccggtaggcaacttctttgcctcccttccccaggcggtcctgggcggatgtaccatcatgatgttcggctccatcctgacctcaggcgttcagatgatttcaaaatgcggcttctcccagcgcaacatcaccatcgtctccctttccctggcagtgggcatcggcttcaccaccgccagcgaaatcggcatatgggatatcttcccggagcttgtgcagtccgtattctctgccaatgtggtggctgtcgtgtttgtcgtgtcggtgttcctgagtctggtgctgccgaaggatatggatattaagatgttggaggactaactgtgtggacggctgtaagtccaagatccatgtaagtccagggtccatttagggcggggaaattccccgccctttccatattgatactatgattccggatacccaatcttcaaagtaaccccatccagtgacactcccttactccgcgtaataggcagcttctgctccgcagtgaatccaagggtctccccgtccctgagcaccacatccccatccagcacatagtatgccaggttcaggagataatccctcagttcctggggttcggccctgacatccagcacttccatctcatccctgccaaatgccctcattccataagtataggtgttccatcccccttcggtctggtacaggccgaaataaatccagttcaggatgggaagtccgccgtccttcatcatttctgaagcatccagataaaaccggggctggaaaacggttccgcttgtatagacgcccagaacggtttcctgtctgcagcaggcagccataagcttggcaaacagcaggccgcgctcctttacaggcgcgtcttttcccatgattgcaaccatcagatgggctttatgtgtcttaacggtttcaacggcctcgggccacatatagttgttggcggcattcgcctctgcttccccctccggcacaggcgcatccatcatggcgaccaccagcctgataccgttgacagagtagatgtggggggcatcctcgtcatcatgtgccgtgttcccttcgtcattggcggatacatcttcccctgatgtctccccatcctcttcctcaatacagtcaatcccccagtccgccttcatatctgccgccagcttgtccggtgaccagtggggttctgagagcaggacaaagcctacgaaggttccggtttcgtcattttcctcctgattcccatcctcatctatatcattcctatctgtatcattcccatctgcatcattccggcctgcatggttcctgtctgcatccttccttcccgcatcctctctacatgcatcattgacgttcccgctatcttcacctgaaccttcaggatctgcaggacgggcctcctgttccagcgcctttgcctgttccatccagtaacggcggatcatctccaccatttcttttgccttgtccacagcggttgcagcatcgtatggttccatctcgctgaatacatggccgcagtgctccgtatctcctggtccgtatccgccgcagacgcccagaagccatttgccaagaatccctttcttataacggaacatgtaataatgcaggccatgaaggtcaaactcccccgctggttctatctttgccggttcccttccaagctctcccggatgtgaaagccactctttcattgactgcatggctgctgcctgttgttggttcatgctgttatcctcctgctattttctataattgaagtaccgctcatggaaatgtcctgatgaaactgattgccggggccattctgtctgtggagttcgttctcctgacagggttaattgtaagcctctgtatgtgtctccggttcctggtccttaaccgcctttaatttacccagcagtccatagattccggcccgctgtccctcctcaaaataggtgatggtcacaagaaacagggatggtcctgaaacagccttgcagaacacctgataataggcttcttcctcatcctccaccttgcgccagccccagcgcgcccggccgtttggcatgtccaggtccttaagctccctcaggccgtcaaaaccaccttccagtgaggcgtccttaccctgaagccggaacccgttcacccgccatatgggatccttgccggtgccgtcccaccataagtcgcagcccctgccattttcctgttcctcccactcatacagataattacccggaagggtcaggcggaggacaccatatccgtatgtcacttccccccttctgaatcccaccggatacagggactccaatacctgggccgtatctggtatgacgggcgtccttttgtccagaccgcacagcagcaggtatgcttccatgggaaggggaatcctggaatccagcctgtatgcctgttccaaatcatcaagggcagcccggttaaggtccgcgtcctgagcgctgcggtccgatgggccgaagaagcatttttcccacatcaggttcagggcacagttcctgtagtatgcagcatccttctcaggctggttccatatgaagaaccggtctgccagccatccggttccaaggcactccacggtcttaaccatgctggcaatcccaaaccgtcccatgggtgtcacaacggttcccgggatatcctcgggctggtactgatttatgtcccagcacagacagaggctgctgtattcctctgaagccaggcgctccctgcacaggttgactagcatcttaagccatggatggaaatgttcctctttcatacgctgaaaatccctgtgactgtaataatcagtctcatctgacacagtcaggcccttaaggacggatttgcccagtgcatccacaaattccaccgccgccttatggaatcctggcccgcagggtgtggagtagcattccccggatatgacccattgacccagcagtccgttttcatgttcccaggtcatggaaatgccgcccatgggacagaaggatatccatatatggtcattgtcctcctgtacggtctgcccaccggattctgcaagactgcggacagcctgaatcagcgcttccttcttccttacctttgcgccaaatgcaaaccgtatgctcatgcctcctccttctttatccggatactgcccgcattgcggcggaaggtatggaataacgcctccttaacaggcaggttcctgaatacctccaccgcggcgttcagcacagcggtcagatcccacgcaataaaatccaggtatccgcactccgtccccgtggcgcctccggtaaataccaccgcatccccacattttcctgatatctcctgttccagcttatcccgcagatccagtatctgattccttggtataccgtccagcggataatagaaaaatccagggaccgccccatcctggtggaaatcctccatgattccgtcatcccccctgtaatatgcgctgacaaccggaatacaggtggttactcccgcatatacgtcttcacgcagatcccacccttcttcctccgacggcttcatctcatatgcgctgtaccactggcacatctggtccgcagtgacaatctccctgtccttttttatgtattccagaaggtctgccaggcagatgtcctccccctcctgaggcgtttccagcagatccatatatcccacataccggatggcggggatttccccaatggcctggtccagcaggacagacatgaggccatacgcctggttctcattttccttcagcaaaggcaacagcttttcacagtaaatggacagtccgatctgtttatcatccagttcctccacccagacccttgcatcttccgtaccgatatccctgtcaaacatcctgagcacaaatccgttggctggctggcgtcccaccaggatattccagttctgatgcacctcctttggcgcatgttccataaagtacttcagtttgaaaatgcggctcttgtccccctccggcgacaggatcaggtcgtatttactgccattgcggcccacttcaaaatacagtcctgcaaatgcaggcgaaagaagctgatgacacaaaccagccacctgttcccctccctgctttacatccaacagttccctgagtttcccttccccctccaggaatgactgccatccctcctttaccctctcgcagaagggtttcattgcattgggaagggtaagggccttcctgcacagggatatcatctccagcgtatcctcatctcccggcctgtactccaatgccttttcaaaatagtaccttgctttggattcctggtccagataatacagcgcgtagcccatcctataattccagtcatgttcccctgcatattccttttccacggattccaggagttccaccgcctttttaaacagatgcctgtcccccggctccgccaggttgttatatgcgcgcgccagctggctggttaattccggtgtctgctgctcccggggcagggcttcaatcgcatcaatgatattctggaactgaccgtcctcatgccactgttccagcgcttcaggaaggtgggatggggtgcgtgggtttgtttcattttcaggcttctgcttcatggtatttacctccatcttgtctttcaatcattatacactagagagggtggaatggatagtaagcggtagaattattaaaacaatcgtaacaaacaggaacggcataccggaatcccagtatgccgttcctgttcctttaatccatgttcctttaatccgtgttccttcaacccatgttccttcaaccttttactttattggtatgtttgcagattaactgattctgtgaaatgtgtcatggacgtgatgcatcagtcatcgtcgcggtcgccgtcatggacatcgtcgcggtcgtcatcatggtcatcatcccggtcatcatcatggtcatcgtcgcggtcatcgtcatggtcatcatcgcggtcgtcatcatggtcaccatcgcggtcagcatcatggtcagcatcccggtcatcgtcatggtcatcatcccggtcatcgtcatggtcatcatcccgatcgtcatcatggtcatcatcccggtcatcgtcatggtcatcgtcatggtcatcatcataatgcccatcatgatcatcatcccggtcaatatccagcactgccccggttaccgcgtccagttccacttcatgtccaactccctggattactacctctatttcataaaccccgtcatccagttcgtattccttgaatttcaggctgtcttcctttaatccaaactgttccaatacaattctctcagcagtttccctgtcgatataccccttgtcatccaacgaatgggttcccactaccttgatatacgcattgatttcacggtcctttgcaacatcacggacttcatcctctatctccctcataaacatgtcgtccggatacctggagcctttttcagcctttaccaccaggctctttctggaaccgtctgcattttcactgaaccaacccttttcatccaggcgtctaatcagccttcccactgctgttttacaactttttccaacatacccgtcctgtccttccaggaattccttaccatcccggtcaaccccttttatctccagcaccgtaccatccttatcataggaaatggatatatccggtcccgcgctcaccaggatacgccccttaatctcttccttattgctcgatgctttgtaagacggagccccgaacgctgtatttcctgctcctgctgcccctgctgccaatatggcggcacatgcaaatacggctgccctgtttaatcttctttttaacatattcattttcctcctgtaatctgtggatgtttttgcttatatacatagattacggaagcatatttttaaaactggggtagagatgattttttctgaaaaattatatttcccattgggaaacggcattcccgtggacagctaccacttttcatgatgaatctttgcggtttcccaccggcagaccgattcctttatcccggcaggccagccaaaagcaatcacggaaatgggttccagcttaggagggagcgccaattgatggattaacaatttccgccaatcagaattagacgccacaccgcaccagacacctcccagtcctaatccgtgaatactgagcagcatgttttgcgttgcggccgcacaatctgcatataagaactcttttattccttctatattcttatctccgcaaacaataattgctcctgcggattcttccatcatcgcagcattgggattattccgggccaggattgataggacatgccggtcccttatcacgataaaatggtacgggcgcttatcttttgccgtaggagcctgcatgcctgcaaaaaggatggcatttaccatatcctggctgactggtttggaggtgaattcccgtatgcttcgccgtgtttttatggcagtaaggatatccatatcactcgtgatatcaaccaacttttcaggtttttccctgacagcatccatatcctcgcaggacatggtaatctccgctgccatcgcctgaccgtcaaacccaacggacttctgcaccgtcttatctaaaaccatgacaaatctcccgccgccgcgggatagtaatttacttcggtatccaatgccattaatcgtaccgcttacataaatcgtccccttaggtttactgaataccgcttttgcatcaaacggaatttcaacaatggtcagtctgcctgaaccgtcctttttaatcagggcatcgaatcgttccattgcgttcctccttccatgtattcgcttttttgcatgatggagcgcaagggcgtgtttgaaaattgctttccgtcagatgtgcgtcccactttgtgggagatttggtcccgatgaggaaggcgtagcgggctacgttgaccgaatcggggccaaatatgccgcgaagtgggacgtgcagatggcgggaatgaattttcaaacaggccctagtcatcgtcctcattactgtccccatcatcttcttcattttcatttcctccattcccgtcctcatcatccgcagcgccatctccatcgttttcatgaccgctgtcatctttccggtcatcttcctggctatctgcgtttccacgcccatcgtcccggtcatctccatgcccacgcccatcgtcccggtcatctccatccccacgcccatcatcccggtcatctccatctccatgcccatcgtcccggccatctccatccccatgcccatcatcccggtcatctccatctccatgcccaccatcgtcccggtcatctccatctccatgcccaccatcatcccggtcatcctcttctccgcgcccatcgtcccggtcatctccatctccacacccaccatcccggtcatcctcttctccacgcccatcatcccggtcatctccatctccgcgcccatcatcccggtcatcctcttcttcatcgtcatcatcccgctcacctgttccaccgcgtcccgcgcccccagtcatcccttctgccgcctttggcacagccggcgcagctgcaggacgggccggcatggaaggatgatggccggaagcaggacgggactcaggacggaccactggagcatccggcgcagcggtccggtcatccccatctgcatccttcatatcccctgcgtcatcccctacctttatctccacttgcatcctgccttcaaactgtctcctcagcccggtaccgatatcgtcttccctcttctgtttccaccgtatgctacccccgtctgctttcaccatcacggttccaccttcagccaggtaccccatgtccacggcgcgttcaaccagaagccgggtaacctcctctgcatgcttccctttgtaagacacctgtccaatcagtctgttcccatcctcattcagcccttccaggcccactacccggtccatgtaactcacggacatcaggacatccggattgattttcaggtgcacggtcccgtagggaatgaaacaggccccgtatcccccgcctcccaggacggcaaggcaaagacaggccgcagccaccatggatgcaagcctcatcctaaacagcgccggcctgtgctgctgttcaatgacatcatccaccttctgccccacctcataccccatatttgccacttttatgatacggcctgcctgatccagcacgattgcgtatgccggatggcattccatcaccagatatgtcatacggatgcctcctttcccccggatacctgacacaggtgcccccggataatctcgtaaccatttgtatatgcaagtaaaatggccatcatgtaggaacggtgccgttccagggtctttctcgcaactccggatacagtggtcagttccgccaggggcagccgcctgcttttcacaaaccggtccagaatccccggattctccctggctgcctgcaatgccttgtggcaggcctgcagtgtacgctcctgtttcggacaattgtccgctacttcggacaggctcaggccatattccataagattatttgcaaattcctccaattcctccctggtagcctcccggaccgtccattgcttcatcccgtcttccccggcaggaatcatatcagaaagcgtatgttcctccccatcccccaatggcgcgtcataggaaaccgtccccttatggcgttcctcttttctgttataatcaaccagacggttgcggatggctgcagaagcataagaaagaaagctgcctcttccccgttcatatccctgaaccgcctcataaaacgcaaacatggcaatgctaagctcatcatccctgccctcagaaggtacggcatgggtaaacctggctgtctcagaccgtatgaaattcatatattgggaaattagctcatcggcagccagcgcgtctttctttgccctgtataccatatgaacgattgcatgctctcctcccatcctgcacctccatttattatagtatacggatccatatccgttttttgggggtaatgcgggtaattatgattccattgtaccatataacgaaaagaactgccgctgataacggcagtcctttaaaaaaatcccggtctctgattgtaacataccactgttgcgcaggccttcccggcaccgcacggatgcctttcatgattccagccattgccggggcattacagggtcttaccactcacccttgaatgtatccacattatccttgttcacttccacctgcctgatttccgtcacaggctccaccttttcaccgtttaagtattttacagatgtctcgatggccagatgtccttcttccactgccgacatataggtggttccgtcaatcacgccgtccttgaccgcctggagtccgtccttacttccgccaagcccgattaccttcacatcttccttcatcccggcttccttaagggcctgtcctgcgccggttgcggagttgtcatcctggcagatgaccacgttgaattccatcttcttctggatcaggtcctcaacaatctttagtgcctgctccttttcccagttggaggtctggttatagataatctcaatgttgctgccttccagggcctgctccagtcccttcttgcggttaatctgaggcgtggttccgggaaccccttcaatcaggattgccttaccgccgtccccgcctaacaggttctttgcgatttcgcctgtaacggcgcctgtgttgacttcgttctgccctacataggataccagccctgcatattcaccggtttcctcggacccaattgcattggtaaatgccagtaccgggatatcggattcctgggcggatttcacaattttctcaccggaaccggaatccacacagcaaagcgcgattaaatcaacgcccttgaccatgaaatcctctgcctgtgccagctgtttggatgcatcccactgggcatccgcatactcaatggtaaccccgtactcagccgcggcagcgtccacgccttccttggttgccacgaaatatcctgtgggaccaggaagcaataccgctatcttataatccttcttttcccctgtggtttcagccgccttggcctcttccccggaactttccccttccgtctttgcctcctctgtcttcggggcctcggtggccggcgctgccgttgtctccggcgctttagttgcattggcagagcctgtacagccagccagtcctgccgccattacacatgccatccctactgctactgcgcgttttactgttctcctcataatcctcaccttttcctttcaaaatacttttttctatcttgtagcaagtctcttcttgctgtaagaatcaaaccccactgcaaccaggatgatcagccccttgaatatgtactggaaatacatgtccacccccagaagattaaagctgttgttaatcacgctcatcatcaggacaccgattaccgtcttaagggccgaaccggaacctccggccaccgaagtaccgccaatcacgaccgatgcaatggcatccatatcatatccatctccggccgcaggactggccgtgcccatcctgcccaccagcacgatgcctgccaggcctgccagcactgcattgatgatgaatacctttatcttgtatgcatccacattgatgccgtttaatttactggcatccgcattgccgcccaccgaatacacataccgcccgaaccgcgttttgctgagcacgacccaggccgccagcacggtcagcgcaaatatcaccacgggaaccggaatccccatcaggtagccattgccaatggcatccagcaccacaaacgtttccgtgatagggtacccgcctgtgagcatgagcatggagcctttcacaatgctgaccatggccatggtggttatcagggaaggaatccctatcttggccaccacgaagccgttcacactgccgatgatcccgcacacggcaagcgccagtatcattgccaggaacaggttcacacctgaagttgcaagcttcatgatcactgcccctgaaagggctgccacggctcccacggatatatcaaaattcccggatatgatgacaaaggtcattcccgctgatatgatcccgatgatggaggactgcctcaacaggttcaatatattcttgtggcttgcaaatgccggcgttgcaatggttatcatcacacacagggccaggaagccgatgaccacaccatactctcttaaatttatcttttccctcatacgtttcccatcagacatcttattcaccccgctaaacattaaatatcttattcatgatatcctgcaccgtcaggtcccggttctccatctcacagacagccgtcccatcccggattaccataatgcggtcagatacccggattacttcctccaggtccgaggagataaagatgacccctatgccctggctggaaaaatcctgtatggtacggaatatatcttccttggcagcaatatcaatacctttggtcggctcgtcatagatgattaaatccaggtcctgtcccagccattttgatacaacaaccttctgctggttgcctccgcttaattccttaaccttctgggtcacgctgcttatcttgatacccagcttcttaaccccgtcctctgcaaaatggatttcctggttccggttcagtaacccatgtttcctgaacctgctgacctgcaccgcggttgcatttttataaatctcctggtccagtataaggcccaggttcttcctgtcctcgggaatgtagccgattctgtgcgcaatggcctgctggggcgacctgatatccacagccttaccgttcaccaggatttctccccctgtcttccggtcaatcccgtaaatcaggttaattatctcggtccgcttggaacccaccagcccggccagccccactacctcccctttgtataccttcatgtccacatccctgaccacatttcccctggacacgcccttcagttccagcactgggacggcagtataatccgcgtagtggtaatccttggaatccttaatccggctgtccgcattgcctgtcatcagctgggttatctttgccttggtcagctcccctatatcatagcttcccaccagcttcccgttcctcatgatgctggcgctgtcacagacacggaacacctcctccaggatgtgggtgatgtatatgatgctcttgcccatctccttcagccgtccgatgatctggaacaggccctccttctcattattggtcagcgaggtggtgggttcgtccatgatcacaaggtccgcattccaggacactgccttcatgatttccaccatctgctgcttggcaatgctgaggcgcgacacaaccgtatccgggtcaatatcaaaatcaaagtccttgcagatgcgttcatattcccggtacatttcctttttctttaaaaatccgcctgccccggcgctttcccggcccaggaacatgttctgcaccaccgtaagggccggcaccaggctcagttcctggtaaatgatgctgattccatgggatttggagtcatgctcattcttaaacgccaccttgccgccctttaagaacacctctcccgaggtctggctgtgcacgcctcccacgattttaatcaatgtggatttaccggccccattggctcccagaagggccctcacctccccctggatcagggagaaatcaatgccttccagaaccttaaccgggccgaagctcttatgaatgtctttcatttccagtatgtattccatatcctgcctccccctgtcagaacggtcttccatccgatggtcctgcgcccagatgaccgctgaccgccgccaggttcccatccgtggcgcccatcagatcccatgaaaggacatatccttccatatccacctgcttcaggccttccatggtctcccgcagatactccgggctggacggcgctgcctcattgcagtttacctcaatcccgcagtataccggtacgcccagtcctgccatatatgtaagctccctggctgtaaaatccaggtcaaatgcctctgttccagtgtcatggcaccccagcacctcaaaaaaggctttccgcgccctggttctggcatccacgtccatctgcgtcccattgcaccgcacggtttcccggatcaggcagtccgtctcaaaaggcatccccgccggggcattggtaatgcggtacatcatgggcttgatgaaatccgccatgggcgccagccgcttcatatcctgccctgcaaaatacgccaggtacggggcaaatgtatccatccccaccttcatccccctggcatggaaataaccggtgaccgtctttaaggccctggcgatatcctccgcctttttcctgtaaaatttctcccatacaggatgtgcgaatgtgtaattccccttatcataggcagttatgccaagaacctgctccccatatccgccggccccgtcacgcaccagccccatctggtgcttcagctcatccacatcaatcccgcactcctggtaccgcttcatgcaggccgggcagaagcagctgaacacaccgcccaggccattggaaaatgacccataccggattttgtccaggaacaccccgtcaaaacccagaccgtcaaaatgctcctcataaatctgcaaaaacgatgttatattgcgctgctggtccgggcaatagaattcaaaattctccccttctgtcaggcagtaactttccgcctccgtacctgtatcgtcaaccagcttcccggtatccgccttcaaaacgcctgtctcggaaaacacgggaagccacagatagcactcgatgccccgctgtctcaggaatccggtgacatgctcatataactcccggctgcaggaccagccgataatcaccttgctgaccgcaatcgttccaagcagctgcataagcttcccgcacaccgcttcatgggtaaccttatgttccagatagcctcctgttgaaatctggacaatgatttcctctttattcatgccaatcctcccccgaaagcccgccctgtccctgcaggccctgccccaatatcctgcgtgccagacgtatgcccccgtaaacaggcgcatgtttctgaatggaaaatgtcacatgctccagcgggatctgccgtgccagttcctccttaatcagctgctggtaaatcctgcttttcagcacaccgcccgaaaaaacaatgttcagttccatcctgctgtcaaatcccatccgcctgtaaatgcttcccatgagccgtgcaattacctccgccccatgccttaatatcccaagggtcacttcttccccgcgtccggcttcctccgtcacaagctcagccagcctggcaatctcataataatccgtcacctcagtaaccacatagggcaggcgctcaaaactgtctgccttaaaatactccctgatacagtcaaaaaatggtgaatatccgccgcagccgtcacagtacagcaacgtatgcttaagggcctccgccccaatccagtacccggaaccaatgtcgctgatattatagccccagccgctggcccgtttatactccccgtcactgccaatcccaagtatgatggaaccagtcccggcaatcaccaccatccccggctccatggcctgggcataaaaggcaagtatgccgtcattgcacagatagctcgtcttcccgtcaatcccaagcccctcaaggactgcgcgtatcagggaaaaatcatgctccgaatcacatcctgatattccccacacactgtagcgcagatccccacgccgtattcccttcttttccagcagctcaaaccctgcctgaaagctttctctgaccgcttccactcccacggatttgtaattgctgcatcccacgatgacactgtcctttatatggccctccatatcgctgatgcagaattccgtcttagttcctccgccgtccacggaaagtatataatcagccattcccttatccccgtttcctgcttgacaaagagtaggttggcgttatctcccggatacacatgccaatcagaccgtaaatgctctgctccctgatatcatccagcttaatcagcttgggaacatgctcttcgccaatgcattcctttaacaattcctcaattccctttacatccgcccttgaaatccggctgcacaccagtcccaccacctccgggttgatgacacagataatgctgagaagcccgttggcaaccgtgcgccttaaaaggcttttaagctccttcctgcgcgtgccgctgctctgtctgatttcctcttccagatggctcatggtgtgttcaaaatcccctttataccggctgttcccgtcctgcctcccagcgccctggctcaccggcaggtaactcagctcccctgcaaagttcgtggaacccttaaacagctccctgcccagaatcaggccggaaccaataccctgttccaggtataccagggccaggctttccaccttatccttgtactggccataatacacgcccatggcagccaggttgatatcattctccagaagcaccggggcgccgtacttctcttccagtacatgggcaacatccatgccctcccagctagggatgttagggatgttggttaccacaccttccttcacgacacccggcacgccaaggcctatggccgcaatctcatggcctgtgcaaaacccgcaaaggacatccaaggccctgtacgtgtcctccatcacctcgtcataggaatccggccttacgggaaattcctttctgtatatgatatcccctatgctgttggacacggcgcctatgtacatattgcagtcataatggagtcctatgatatagtgcagctcttcatttatctcaaaatactgggccctgcgcccaaccgacgaatcctgcacattgctgagctttaccttattctccttcaccaggatatcgacggtcttgttcaccgtcaccaggctcaggttggtcagtcttgcaatctccggctttgtaatgggtccgttcaccttgatgatgccctctattacatccttgttcaaaagcttgatcattctgggagtccctaccatctcagccatatcctcatctcctcaccgtggaattaataaataaactttattaattaagtatggctatattatatgcacaaaccaggcatatgtcaatacttatccgtcaatttatctattttattttttcaccaacatatctttttatgcactttccatatccaccctgttttttgtcttatccggtatacatgcaatgataaaaatagtataataacaaaaaagaatcaggtggtaagatgaatcaagaaaaaatgctctcacagaacgcagccgaaaccatattatccatgataacggttgaaaagcggttttcaaccggggacaggctgcccaatgaaacagaactggcagaagaactgaatataagcaggaccacgttaagggaagcaatcaaaatactcatcgcatatggtatcctggaaatccagcgcggaagaggcacctatgtcatcagggacaccctgccccaatccacggagcttaaatccctggcaaccgtaaaggtcaatgccagggacctctatgagatgcgtctcatatttgagcctgaggccgcttatctggctgctgtccgcggcacggacgctgaaatcaggcgcatcacgggatatggaaagagaatcgaggaagaaatacagaacgggcaggacaggaccagtgacgaacatgccttccacaaatccattgcccaggcaacccacaatgaattcatgaaccaattaatgccgattttataccaggccattgccaaaggcgtctgcctggcctccgggagcggcaaagccatacaggacaccgtcacggaccaccggctaatcatggaattcctggagcagcgcaatgccgagggcgcaaggaatgccatgaagatccatatcatgcacgccatgaaggaactggacatggagtgagacgtaagccgttaccccaccgggggccctgtacctgagccggaaaactgaatatcccatgatgaaagccagtatccgtccatccggcggcactggctttttaatgtccacagcccattattacagaagctgtccagagtttcattccttcccgaagtatcattcctgtctggagtttcatttctgtctggagtttcattccttcctggagtttcattcctgcctggagtttcattcctgcctggagtttcatttctttctagcatagaagtgacatataatcctatgaaaaacaaacccatatacatactatgtcttattgacatcatatgtctacaggcgtataatcaatccatataataaatcattcaaaacggaggtctgcaaagatgagagaatcaaagataaactggattgacataccaacctgggacagggccatgcattatcaggtattccggaacattccccagcctcagtactgtgtgacatttgaactggacatcacgcagttccttccacggatcaggaaaaaagggtactcatttaccttttccatggtatatgccgttacccggtgtgccagccaggtggaagctttccggtgccggttcgtggatgggaagcctgctgtctttgatacaatcaacacctcgttcacatatctgaatcctgatacggaactgtttaaagtggtgaatgtggacatgcaggacaccctgcgggaatacgtcgcccttgcctccaggacagtcctggaccagaaggaatattttaccggccccatgggcaatgacatattccagttttccccattcccatgggtatcctatacccatatttcccacacggactccggtaaccgtgacaatgccgtaccgctgttcgactggggaaaattttatgaaaaaggcggcaggataaaactgccattttccgtccaggtacaccactcttttgtggacggcgtacatattgggaaaatggcagatcttctgcagacttatcttaatgactttaacgccggatgaccaatccggaaatcaactgatccggataccaaccggtccagacatcatgaaagtgcttcattcagttcctcagttcccggcagcacgaaccgtccctgccggataatataaacctcctgcccgtccttccccacggccttgatgtcaccgagttcagaataagggatggtaatgtccgtatggcagctgaagtaagcttttgacatatcctccttgcgcagaagggatatctcgttatccctggcaatgatttccttgccatccgggttatacataggcgaatcctcggcaaagctgtaacaggtatcccccaccgcaaagtgaggtcccatcttctccgcaatcaggatgggcagcttatccccgataccaaacttccgggccatggcataggcagccgtgttggtgccaatggcaaattcccccaggggcagccactcatgattgcgcatgattacctgcttcaccagcgccctgccctgggcagcaccgttctcagcagcatcgttatcggcaacatcgttcccagcggcatcgttatcggcaacaccgttcccagcggcactattctcagcagcaccgttatcgatagcaccgttcccggcggcaccgttctgggcatccccgcccagtacagccccatccgtttcaaaattaccgcaggaaaactccgtgacccttccatccttaaaccgcatcctaaggtttttgaactgataatcctccacatacacattgcgcacatgcagaagcccttctgtcccggtcaggacaggagaggtgaacacctcgcccaatggaatattcacatcggaaacacagttctcaaagttcgtttccctgcccgcgtcattcagggtatggagcatcaccttcatacaggtctcgttatcgtcccgtccggttatgattatatgcccggcctgatccagggcgtcgatgatgtgctgctggatgcgctggtatctgccgtaatccagggtgttaatccgtatggtctcccggaatatctcctcaaaatccggcccgatatcgggctttggaaatgcaatgatggtaaaactggtctcatcccctggcatatactggtttacaatctgccttgattcattggcataggcaaccgtcagttcctcctggtgtccgttaagggccagggctgttttcttgttgacaggcgtgaacccggcctccccaaaggtctccaccagggccggtccggcgcaccaggaagccagctccttatactcctcataggcagtcttcagcacggaaagcctgcgctccttaaagccattacccatatacagggcgctgtcatagcggtggtcataatcatactgcctgttggccgaagtcccataataaccacgttttccgccggccctgcggttcacggactccactgtcgcccggtaggaaatcacgtccaggcccatggcacggaaattctccactgcctttcgtatcatccgctcaaagcccagctggtattccaccaccacggtctttttcctggacaggtcccggcccatgacctcaaaccctttgcggtaaccctcggtatatgtgtccgccatcctgtcaatggtttcctggggcaggctgttcataaaggatgccagcttcagttcagtatccgatatatattcgccgtactgatacagatactccaggctgcttaagtcactgtccatgatgatatccctggcaaaggacagaccggggtccaatccctcccgcacccgccaggaaacagtcaggtccgtataatcgctgacaaaccagtacagggcgtccttgaccgcctgcttatcaggcgcatcccttccctcttcccatgcaaggacaaacaggttataaacctccaggaacacctcgttcaggattgtcatgtgggtcagccgcatctcgtaggcatacacgatatccccgcggatttccgtatagagaaatgacagcagctgccccatgccatctgaaagctcactgaccgcataatcgggattggcatagctctccccatagttttcaggcaggatatcctcatacagggcgtggttttcccgcttaagtccttccaggtccatgtctgtatgaccgtttccggacgcggggcagcccgccgggttttgtcctccatccccggcattttccccggcttcttcccctcttctcctgaccacttcccccacctgcatgatgaatgcagctgtcttcttaaaataactgccgtaaggcagcctcatctcctccgtctccatggccttaatccgttccatggacagttggtagcgttcccttacggcatcattttcttcctgtaataaaattctgtaatccatacgcatttactcccatctatcttacaaacccggtgattatgatgacaatccatacaatcagcagcaccaggctgatactgataccaatttttgccagtatgtaattacgctccttttccgtaaatgacagcagcccgaaccacattcccataagggccgccgcaatgctggcaaacccccatgcgcctgtattcagcccgccctggcctgccctggccacggacaggtacatactgcccgccccaaggccaaggcttaagatggcaagccccaggcagtaatagctgttccttgcaaagggattcctgacataagataccttatccccaatctgtttcacttcattaacctcctgcgtcttatcctgacccgcgcccactggacgaacctgtacgccagatatccaagagccgcgccaagggtattaagctgcatgtcatccacatcaaagctgcctaccatgaatatgagctgcagtgtctccagcatcaggctgaaaccaaatcccagcatgagcgtgttataccatttcttgctccttctgctgatgatggggaggaaaaaaccaaagggcatgaaagccgcgacatttccaatcatgttaataagaaacagcagaggcccaatggtactgtaataccggaaatatctggagatttccttaaagggcaccagattatactggtaccccctgctggtgtccgtccgcccgaagctctctgaaaaaaacatgaaataagccagaaggcacaggtacaggataaacagcacccagcccagtttttggcgttttgttgtatttttaatcattggcagccccgttcgttaaaatacaatatctgatttacgctttaaaagcagggcaccgtttattatggaaatgactcccactgtaagtcctgtcactgcaatgatgatgccgataacaatacatcccgcgcctgtattgcgcattgtcttatatattttctccatattcatcgcctttcctgttggtaacgtgttgtcatgcctgggcgccatactgctcatagtaagcgtcaatggctgcctttatctgatcgtcgatgactactttgccgccgcagtccctgttataaagatgctcaaccacatccgccatggatacgatggctgctgtcgggaatccgtataaatccttaatctcgtccagggcgcacttcgtccccttgccccgttccatgcggttcaaggatacgataaggcctttaatctccacattcccctgtgccttaaggattgggaaggtttcctcaatggacttaccggaggtggtgacatcctcgatgatcatgaccctgtccccgtcctttacagggcttccaagcaggatgcctgtgtccccatggtcctttacttccttgcggttggagcagtagcggatatccttgccgtataaatcgctgattgccatggtggttgcaacgcttaaggggattcccttataagccggcccgaaaagcacgtcaaaatccagtccaaagttatcatggattgcctttgcatagtattcgcccagtttccttaactgggttccggtcacatagcttcctgcgttcatgaagaagggggacttacgcccgctcttaagtgtaaagtcaccaaacttaagtacattgctctcaaccataaattctataaattcctgcttatagctctccatattatcatacgctccttattattataggcattttcgccatttctatttttctattttccaaatctgccttactgtatcatcataatgtcattttatatcaagcccatgggcttatccgtccatttcccaattccttccccgggagatttaccagtgtcccctcctttcgacgataataatcgggaaagaaccgtcatcaggacattcatccttgattctatcacacctggtatatattttcaatcttcaatccttatagaatttgattctggaaaatttgtcccgttgcctttcagtcatggtccggcccatgtcctggaattgccggaccaaatggacatggctgaccgcttatgataaaatatccatagtaccatcagcagcaaggtcaacagcaggactgacggcatggtcaacagcgtgacaacaccggcatgctccaaaccatatatggaaaggaaggttaaaacaaaaatgaaatgcagatgcggcggtcttttacatatgagcgcaggcgactccatacgggacggggtgtaccgttggcatgcctcataccattgcagtcaatgcggtcaggaaacggaagtggatgggacaggaatcggccttccgcctgatatccaggactccatcactgcgttcgaaggggtatgggaggtgaaggcaggcgaaggacacgccgcatctgccagctatttattgggtaaaatcttaaaagactgccagctgcccggcattaccagggattctggcaatagcggcatggtctattacggaacccgtaaccaggcattatggctgaaggataagatgattcaatccgggatggctgaacagggcctgatctgtcaggaagccgtgtgtgaacacgttcttggccccgaagacataaaggcctggcttggcagccgctatgatgctgtccaccatctcaccgggaaggtactcctcaccaaatggccgtcctccaaagcggagggcctgcttaagattaaaaagacattcaaattacaggtatctgcatccgtgttactgaaggcagggcttccctatatcataacagaccgcctcatccaatgggatgccctggaacgcatggaggaaacaggctgcccggaatgccttgaatttgtctgtgatacccaggtggcggatggaaagggatatttttcttttaaagaggtcctgatccggtatgccggagaggaaacaggtataaagcgttgtgattttcacaataccgtggaatgccggattgccactgaggaacaggcgctggaacgcgcaagatcagaatgcaccatcgggtacacggatacccgggtttaccgcgacttcacggaccagatgtggcttgtcttattctttaccgccagtgccctgggcggctgccaggaagtttatatggacagcagcgggattacaaggttaatcgtgtatggtgaatgagaagcatggaagccgtggatgtgttatacatcaagttccacccacaaggcagggaacgagaaatcatgtaaaataacagacctggacgcggattcaatcccacgtccaggtctgtttcatatatggaccagatcatcttaagaaccaactatcttaccaccctaaccagctaccttaccgccccaatcagctggcttatatcgtcaatcccataccgctccatataggaccggattccttccactgcttccaccgttgcataaggattgtggaaattagctgtaccgattgccactgcactggcgcctgccaggatgaattccagggcatcctccccattcatgataccgcccataccgataatgggcacctgtactgcctgggctgtctggtagaccatgcgcagggccacgggcttgatggcagggccggaaagccctcccgtcttattggccagggcaaaggctcttttgtgtatatcaatcttcatgccggtaagggtgttaatcagggaaatggcatccgttcccccggcctgggccgccttggccatgactgtgatgtccgtcacattggggcttaacttcatgatgattggctgctttgcatgtgccttcaccgccttggtaatggcctcaaccgctttggggtcctgtccaaaggcaataccgccttcctttacattggggcaggagatgttaatctccagcatatccaccggctcatcccccagccgctccaccacatcaatgtaatcctccgtagtcctgccgcatacattcacgataatcctggtgtcgtattgtcttaagaaagggatgtcccttttgataaacacatcaatccccgggttctgcagcccgatggcattaatcatcccgccgtaagtctctgcaatcctgggcgtggggttgccgggccacggcacgttggccacgccctttgtcacaacagcccccagcttgttcaaatccacaaattcgctgtattccacgccggagccaaatgtgcccgacgcctccatcaccggattcttgaattccacaccggcaatctttacactcatatccatcttccgggccacctccatcatagttcaatctcatctgccaggaacacgggaccgtccttgcagatacgtttgttgtgcacctgggaatggccgtccacatccttggactggcacacacaggccagacatgcccctacaccacaggccatcttctcttccagggacaggaaacaggggatacccagctcagccgcgtacgctttcagcgcccggagcatgggggtgggtccgcaggcatagatgatgtccgctgacagcccctgttcccttatggcatccagtacatttcccgccgtgcctgcgcttccgtcctcggttgccacatggacaggcccaaatgccgcaaattcatgtttcaggaacatctggctgtccctgtatcccaggatggactgaaccagcccggtccgtccgccgtcctgttccggcaagcctccatccggctgcgcgccagcctgtgccaaagcgcttccagccggctgcgcaccggcctgtgccgaagcgcttccagccagctgcgcaccagcctgtgccaaagcgcctccatccaaccgtgcgttggcctctgccagcgcttttgccagttccagcataggcgggataccaatgccgcccccaatcaggaacgccttctttccaggctccatggggaatccattgcccaaaggccccagcacgtcgatggtatcccctgccttcagctgtgagaactcctttgtccctgctccggcaatgcggtaaaccaggcgcagttccccggcctccctgtcaatgccgcacaggctgatcggtcttggaagcagctttgcgccgtcctttgtataaagggaaacaaactggcccggcacagcatcctctgcaacctgggccgcctttatcctcatatcaaatatatcctcagtcagctgttcctgtcctgtaaccacagccgtcatctttatctttgccatagaaaatctccatctttatgttcttacagcaccggcaatgcctgccggtgctgcagttatttacagtacgctgttaatatcattcaccatatccacaacagcctgtctggatgccccgccaaactgttccggaccaaactgcttatacttctcctgcttataggcggcaataatgcctctggatgagttcacgatggcgcccagcccgtcctcattaaagcaatgctttaaatcctctgccgtaccgccctgcgcgccataccccggcaccaggaaatacgtatgcggcatgagcctgcgaaggatcttactcatctcaggataggtggctccaaccacggcgcccacgttgctgtatgcgccgtccatggaggattccccccactccatcaccttttcagccacccactcatataagggccttccgtcaatgagacggtcctggaactcgccgctgcttgggttggaggtcttcaccagcacgaacagtcccttgtcatcgctgctgcacacatccacaaacggcttcacgccgtctgtccccaggtatgggttcacggtcagcatgtccacgtcaaatccgctgaaaacattgcttcccacctgcaccttgcccaggtgtccggctgcatacgcagcagaggtggaaccgatatcgcccctcttggcatcgccaatcacgattagtcccttttcgtggcagtaatccactgttttcttatatacaataagaccttctatgccaaactgctcatacatggcaatctgcggcttaacagccggaatcaggtcccatgtatggtcaatgatttccttattaaattcccagatggcctctgcggctcctttcagggtttcaccgtaggtgtcaaaggatttcttcaccacatgctccggcacataggacagcatcggatcaagtccgacacagatgggggcattggttttctttatcttttcaatcaactggctaatcatagcgtcctccttatgtatgggtactgaaaaactctttccccattctaacatataaagtatcgtgtttcaagggcggaacgtatttactcttcctgatttttattgtatgctaatactaccttacaaatcagaaaacagcaacaggatcaggagaaaccatcatgagtgtatttcataaagacagggaactggaccacatgtttgaactgcaggagaaaaacagggacagcggtcctgaccgcacggcggacatgtgggacaagaggatgaaaaactggaaacagaacttctggacagccaacctaaaggacaatggttccggcaagtccatgcgcagggtcagggaaaccgccgcttatctgaagcaggcaggggtccttggaccagacacggatgtgattgacatcggctgcggcccgggacgctttgtcgcggagtttgcccgcaccgcccatatggtggtgggcgtggacatttccccacgtgccattgaatacgcccgtctgtttacaaaagagaccgggcagatgaataccagcttccttgtcagcgatttttcatcccttaatcttgaagctgccggccttaaccgtacatatgaccttgcattctgctccctctctcccgctgtctcaggcagggagggcctcaacaggttcatgggactcacccgctcctggtgctgtatgaactccattgtatcaggccgtcacggactccaccagcgcattgccagggaggtctttaataaggagacgctggagagctggaacggacagcatttttacaccaccttcaacatccttctgctgtcaggttatcagcccgtaaccagctattaccagcaggtcaaggaaaatgaacgcccggccagcagggaattcgcagagatatccgcctccatcatactgccggaaaaggaacggaccagcgatgcgattgataagatataccactggatggaaatgcacgccgacacagagggcaatctccatgaaagctccctgtttacctatgggcggctgctgtggaacatccaccagacatattgactaaggaaaccgattttaatagaagacaggggaaaatcatgttcaggacagaaacaatgacagcaggccacaaagattatccaagcgtaaaaagactatatggaaccgcatttccagcagaggaacgtgttcctatccgttatctggaaaacggccaccagggaaacggggacttcattgcattttacgaggatgatgcattctgcggatttttctatctgctgacctttggggaccttaccaacatcctgttcctggcggttgaggaatccttaaggggccatggctacggcaccatggcgcttcaggccatccgcagcatgaaacctgataaccgcatcatcctggacatcgaggccgtggacaggcatgcggacaaccacggccagcgcctgatgcgccggaatttttatcagaagaacgggtacaccggatccggcatcacctaccgctggcgcggcgtgacatatgaacttctgattgcagggggaaccataacagaaaaggagtttaaagaattctggaaaatgccggacaggcaaagggactccctgatggaaggacttttacagaagccttatgccgtgattgatatattcccggcacaggttccggctgaccggagcagtgtatatctggaaacagaaagctggttccttaataacggtgaatccaaacgtcttgcccgtaaattggcacgcattctggtaaagctgcactgttactttgatatcgacatgcacacagagggctggcacagcggcatatccgctgcaaggctggaaaaagcagtgcgtcacgccgtgaaaaacagcaagggaggactgggcctgcttcttgcacaggagcagaccttaatctgcctggaatgcagctccctccatatgaccgtataccatccaagcagcagggtacgggaaatcctaaaacccctggctcagtcggaaggattgttctggcgggagactcccaatgatttttaaacggaaacagaccctcaatctatgcttcagcaataagcctgtttagttccgggattttccagcctacatcttccgggcaatgtgcatccgaaacagtgatgattttgatattatgttttttcatgcatctcagcaaatccttattcataccaacttcagcagtatcgggacaccttctgttgatgccgctgctttgttccgcatacatattttgcccggaaagcgcctgggccattgcttcataatatccatcaagtgaaaatgtaggcgtatggccgaacagctttatgcagtcaggatgggcgatgccgtcatatatgccgctctgaatcagttccaaagatgtttcaaaatacctttggtatatccggtccacatccttgccatcccaatgtccggctttgtgatcaaaggcaaaatcatccacaaaatgaacgctgcctaaaacgaaatcaaaacccctgtcctttgtcaaaccagccactaatgcctcaaactctttgaaataacagatttcaagtccaaatttgatttttatcggaaatgcacttttcctggcttcatggataagcctcaaataatcatccagccccagcacccccgcctgtctatgaaaccattgattgacatatccgctgtatgcgcatacggaatcatacataggaacaaattcgcgaaaacggtaacaatgctcaagaagccatatttcatcgaggccatgctcaaggccctcatctgcaaaacgccctatccattcaagcgtgtatctgccccgttcaatatgaatgtggccatctaccatagcgcaaacctcctctgcacaaaacataacaatatcacggttgtttttgggattccattataccatatcctttgttgatttaccattttatataaaacccaaaatcaaaccccaaaatcaggcttcacacttttttaataaaaaattagcactcacctcttgacagtgctaacaatcgtgctataatacagttatgaaaaataaaacaactcaaacagtttaacaaatattagcaaggattctcccatcctctaaggtggtgagatgaattgccaaaaacaaacttaacggcagtggcgggcagagagtaatcggtatcccccactgccatgaggtcaaccacgcatctacgtaggatgcagtcgcacttcgacaatataccgagcgtggattgaaacaatatatttaaggaggatatgatcatgatgttaatcccaagaagaaactatggacttaatttatttgatgaatttttcaatgacccatttttcagcggttccaccgaaaagggcagtgacagcaagaagcttcccatcatgcgtaccgatataatggaaaaagatggaaactaccttatggagattgaacttcccggatttaagaaagaagatatcaaggcagaattaaaggacggctatctcaccattacggctgaatccaataactccgctgaaaacaaggacgagcgtggtactgttatccatagggaacgctacaccagctcctgcaagagatccttctttgtgggagaacagatccgacaggaggatatcaaggctgggtttgaaaacggcatcctgaagcttcaggtaccaaaggacagccctaaggtggaagatacgccaaagtatattgatatcctgtaatatggcttaccgtacagcctgcagtaaaccgttccacttatttaccaccactcccttttcatatatatcatatgtcatgcaggatgccgccgggtcccccaaccctggcggcatcctgcattctgtgatgatcacgccatgtcattctgcatgcccatccatcccctgcgtctgcctcttccatatcagcctgtcctccttgattgtagccagtacccggatatcccttatggcctccggttccacggacatgggattcctgtcaaggattacaaaatcagccactttcccattgacaatggagcctttttcattttcctcaaaatactgatacgctccgtttatggtcagggcctttaatgcttcccatacaggcaggcattcctccctgccaaggaccatgccgccctttgtctccctgttcacggcgcaccagagggtttccagcatatccgggcggatgaccgggctgtcctgatgcagggtaaataggattccctccttcaaggccaatcctgccgggcttatatggctggcccttttgatgccgaaattgcggacatgcacatcgccccagtgatacacatgggccaggaaaaatgaagggattacctttaattcctttaccttgggaagctggtccggcgaaaggagctgcgcgtggatcatgacgggacggatatcccctggataagatgtattgcccttcttctcccccaaaatcctgtacgcggcctccagctggttcaaatactgtccgcaggccatgtcgccgttacagtgggccagcagctgcatgtcatcctgttctgctttcatgataccggctaatacctcctcatcggaaagcgtgccgtatcctttataatcagccggctggttccatccctctacctgctcatagggttcccgcatccaggctgtcctgccctgtggggagccgtccaggaacatcttatagccgccaagttttatatggttcctgtagcattttacataatccttcatcgcttccgccaccgcatcgctttcccggatatcggcatatgccaccaggtccagtttcagcaggccggccccctccagcatccggtacaggggcagaagctttgcaggcagcattccttcctggaccgtggtgatgccgttggatgcatacagctcctgggcgcggccataggccttcaggaactcctcgggcgacggcatgggaaccttgtcctggtactccaggaatgccctttcctccatatatccggtgggaatcccatcctccttttcaataaggccgccctggggggaccgggtctgtgcatccacttccagctggtttaatgccatggtgttgaatacgcccatatggcctgactgatgctttacaatcagcgggttcctgggacttgccttgtccagcaccttcctccttggatgggttccttcccccaggctgttgtggtcatatcctgccgcctggatccacctgccttccggtatcttctgctcccttataaatgcctggatacactggatgatttcctcaaaatcccgggcatggcttaaatccacctccatggtctggctggcacaggccgtaaaatggctgtgggggtcaatgaatccgggcagcatcacatttccctgtaaatctgccatctggactcccggctgcgccatctccttcaaagattggtagtccccgacgccaagaatcctcccattcccagtgagtaccgcacccacacacggcttttggtcctccatggtcagtatggtcccgttatgataaagtgtctgtcccatatactgctctcccttcccaatcatgtgttttaaatgatttgactttcttgtccattcttagtatattaccctatagattgattcccatttgtttaaagtatgctcacaaaaggagttccttatgattgtcaaatggattaaaaaacacagggtcctgaccgtcctgctatttgtattcctttatctggtcatcggcgcaaccgcgcccttttatcattataaaccggtttccgggataacgaaagccaatacttctgcctcagacttctatcaggatggaaccggctgtgacagggccatgatcctggagacgaaccaaagcgcatgggatgaaaggatgcgcctcatgagcctggcaaaggaacggatcatactgtccacctttgatttcagggacggcgaaagtcccagggacatcatggcagtcatgctccataaggcagaccagggggtgaaggtccagattctggtggatgggttctccgggctggtgcgcatggaacggaacagctatttttacgcactttccagtcatcccaatatagagattaagatttataataaattgaacctgcttctgccctggaagacccagggcaggatgcacgacaaatacgtgattgctgacgactacggctatatccttgggggccgcaatacctttgactacttcatcggctcctatcccaccaattcccgcagccatgaccgtgaggtcctggtctataacacggcccacggcactgccgggaccagccaaagttccctgaaccaggtggaggcttactttaaccaggtgtgggatctggatgtatgctcactgttccatgatgatgaaacgctggctgaaaaggattctgttcaaaaggcagccggggttttaagggacaggtatgatatgctggcaaaggaaaatccggaactgttaggctgggaaatggaaaaatccgcatcctgtggcgcaccgggacagcccgcctgccccgccctgcccattgacccggacatcaatgatgatgaccaggagatactggcctccatcaagccagctccccttgcctattatgaggaacacacggttcccgccggaaagattacccttgtgtccaatcccacggacatatatgcaaaggaaccagtggttttctacaccatgacggaattgatgaaaagcgccagggaacaggttgtgatccacactccctatgccgtattcaacaggcacatgtacgacgccctgacagaggtaacggcccatgtcccggtaaccatgatgattaattcagttgaaaacggagacaacttctttgcctccagcgattatccaagacataaaaagtcattcatccaaaccggtatggaaatcctggaatatgacggcggcctttcctaccacggcaagtcccttctcattgaccatgaactgtgcgccgtgggatcctataattttgacctgcgcagcacctatatggacacggaactgatgctggtcatccaaagtcccgagcttacatcccagctggaggaatacatggattcctatcaggccgactgcaggaggctcctgccggatggcacctatgacataccggaacacatcacggttgcttatgtcccgttttataaaagggcggcgtggaaggtggtcgggttcgtgatgcagcccttccgttttttgatatgaatggaacatggatgcacaacaccgggcttatttcagcttcccataaatgcaaagatcataaacccgtccttcttttacaactgcattcttcagtattccctccagcaaaaacccgttcttctccagtacccggcgtgaaccgctgttgggttcatagaccagcccggtaatacggatgatatccaatgaggaaaatgcgatatcacatatctgtcccactgcttcggtcatgattccctgtgaccatttttccgtaatgagcagatatccgatttccgcatccttcccataaacatctgatttctgttcaacggaaatattccccacaatcatcccatccactgagacagagcggaaaatgccgtctttcccatcgtgtccctccaccatcttaagccaccagtctgcatccgcctccgtatagggaaacggaaggcggccggtcagatagctccggtcagccgcattacatattgccataaggctttccttgtcattgacagtccattttcttaattcaatcttccccatcctatatcaccctcctatccttccacttccctgtcatataccggctaaaggaaatcacatagttggcaatccagcccatgggcaccgcataccatacagccgcaacgccccacacaggagcaaaatggaaggctgcgtagacacgtatccctaagttgaccaggttggcaatggtgaataccagcacgtcgccggaaccgcgcagcacgccgtccgtcactgcctttagcccaatgaacaggaagaagtatgcgatgaaggacagatatcccgtgcctgcggcatatgcctccgggctcatgtccccgcccaggaaggaggcaatcaccgggccgttgaacagggataccaccaccgcgatcacgacggcaaaccccaatatgatccggtagcttgcacggtagcctttccttacacgctccagctttcccgcgccaatgttctgtgccgtgaaggttgacacggcattgcccgtggcaatcatgggcaccacgcagatggattcaatccggcttccggcggagtatccggccagggcggcggagccgaatccattgacaaccgactgtaccagcagcattccgatggagacaatggactgctgcaggatggacggcaccgcaatcctggtgcctgaacccagcatggccctgtcatagaaccggaaaacatcctcccatgaacgttcatagcccttcagcttctttaacagcaggctgaaggaaatcagcgcggagattccctgggccatgaccgtggcaatggcaacgccgtccacgcccatgcccagccatgtgacggagatgatatccaggaccacgttcaggatggaggaaaatatcaaaagatacaggggcgtcctggaatcacccagggcattgaatatggctgccagcacattatacatgaacaggaacggcagtcccaggaaataaatccccaggtacagcctggcctgtcccattatgttttccggcgtattgagggctgtcaggattgtcccgttcatggcaaatcccacgcccaacaacaccaggcttacggccaggaaggtgataagggcagtggaaatggatgtcttcatctttccatgctgcctggcgcccagatactgggatgtcagcaccgaggccccgtttccgcctccaatggcaatcatgatgaacacattggtcagggcataggatgcacccactgccgccagtgcatcctcacccacgaagttgcccacaatcatggaatccgccatattgtaaaactgctggaacaggttgcccaggatcatgggaaatgcaaacatcagcagactcttccccggactcccttccgtcaggtcaacctgtttctttaactgacgccctgaggcgttttcacttaccgtatcctgactcatctcaatccctcaaattcatccagaagttccccaaagaatgccagcgcctcatccaccggcctggtggtggacatatccacgccgcacagctttaacagttcgatgggcgtcatggaacagccgccgcttaagaatttcttatagccctccagcgcgccctcttcccccttcatgatccggctgctgattgccactgccgcggaaaacccggtggcatactggtacacataaaatggggtatagaagtggggtatcctctcccattcatagtcaatctgggcatccaccttcatttccggcccaaagtagtccacattcagctggcggtacatccggcagaggctctgcgctgtcaggctttcccctgcggcccctttcttatgggccatgtcctcgaactcagcaaacatggtctggcggaacagggtccccctaaagctttccaggaaatgattcagcagatatgccttttcctccctgctccccgccttcttaagcagatggcggattaaaagcgcctcattgcaggtggaagccacttccgccacaaatatcttatatccggcataggtaaagggctggttcttatcggaataccagctgtggatggagtgtcccatctcatgggccagcgtgaacacgtcgttgagcgtgccgtggaagttaaggagtacgtaagggtggctgccataggttccccaggaatacgccccgctcctttttccttcattttcatacacatcaatccagcggctgtcaaagccttcctggaggatggacaggtattcctcacccaggggcgccaggccttccttcacaatggacttggcctcctcataggtatagcggcggtcatattcagccaccatgggcacgtacaggtcatacatatgaagctcatccacgcccagcagtttccttcgcaccccggcataacggtggagctttggaaggttatcccgtaccgcccggacaaggttgtcatagaccagttccggcacctcattcccagccaggtagtactgtctgctggattcatacttcttcgcccttgcatagaacacggcctgcttgatattggcggaaaatgcagccgccagggtgttggagtactgggcatacacactgtaaatcccttcaaaggcatccttcctgatcctgcggtcctggttctccatcagggaaatgtagttgccgtgggttatctgcacagcctccccgttctcccctgtgatcacagggaacttcacatccgcattgttgaacatggtaaatatctggctggctccctgggtggcatcataggactgggccagcagctcctccatctccccggaaagggtatgctcccttttattaagcaccatctccagcgcacgcttaaaatggctgattccattgtccgccttcatgtatgcatccagcttttcctctggcatggaaaggatttccggcacaatataggaggagtactcagacgccttgtaggacagggactgggccctggaaaacatatcctggtatctctggtctgcggtatcctggtcggagcgcatcctggaatatacatagagaagttccgtctcccttgatatctcatcatcaaacttcaggcacgcgtacagcgtatccgcggattcatccagtcttcccttgtaatccgcatactgctttaccttggaggacgcctcctcaaacaactgctcccaccggctgtcgctggcaaccatatcctccaatttccatgtgtccttgatttccacttcactgcgcttcttcatgcggccacgctcccttcttacctaatgtgtgtttaactgtttccctggttatcttttacattaccttccatacgtaatcttccattattattttataagattcgccgccagcggcaccacaatcacggtcatcagacctgccactgcaatggaaaggctgctcatggcgccttcgatttctcccaattccagggccttggccgtccccaccgcatgggcgctggttccaagggccagcccctttgccaccggatgatgtatcctggccagccttaatatggattccccggccatattgcccaggaccccggtgagcacgatactcatgactgtcagggtcacgatgcctcctgcctcctggctgacccccataccgattgcagtggtaatggactttggcagcagggtcacatagtgggtatgggtcagtcccaggacccggcacagcaggaaaacactgaccgcgctggtgaccaccccggccgtgattccaaggataaccgcatccccatgctgtttcagcagatgcagctgcttatatagcgggattgcaaggcatacggtggccggagtcagaagccagctcagataggatgcacccttattatatgtttcataatccattcctactccaaatatacaggcaatgatcagtgcggcggataccagcagcggattcaggattgccagtccggtccttttcttcagccagcaggcaaacagatatgccccgatgctgaggaccaggccaaaatactgggactgttctaatataaggcggatactatcccttatgctgctcatgctgcattccctcctttggcttcctgctttgcttccctgcgccccatgacccactgggccatccgtccggtcacgatcatgaccagtatggtgctgactgctatgattacaaggaatgggagaagcacggccctgacctcggctatggattccacaatccccacggtggctggtatgaacatcatggtcatggtgtccatgaggaaattgccggttccctccacgctttccagtttcactaccccgcacataagtgctgccagcatgataaacagcccatacacgcctgccgggacaggcaggggcagcacctggtacaggatctcgccagccatggtaatgcccagaacaattccaatctgttttacatatttcatctttatgccttccttctgatgcttttgccggagaaatgtcgaatctgccccgcacatggcttttattctaccacccggtttttacagattcaacccgtagattgagaaatacacaagaaatacaatcctgcaccgttgcattttcccctcccatcccctacaataagaagatatcaggcagccgcatccgccttccggccagactggaaaaagaaaggaaaaacgccatgaaaataatccataccccatcattatcccaggaacagaccaaagacatacacgccatcaccggactctgccgccagacagacggcaccgtcctgtcctgcccggaggacggggatcatttctggcttttatatggggacggcaaccgtatggatgcatttttcgcagcctatcagatggatggttcctcctgggaatgcagtgcatttacccggccggactgccgcaatcaggggcatttccatgcgctgctggaacaggtgtgcagggacagccaggaggaaggcgaacctgacctgtgctttgtcacggacaaccggtgcccggatacccttaagacgctcagacatctggatgcggaattcttatatgatgaatacatgatggaggcagacctctcccaggcaaggggcggactgcggctgcaggacctggacagcctctgttccgtcaccgcggaacccataacggaggatggggaaatgtccctggccatgtggatttcctccggattggattcctccctgggggggtcctccgaatcggattcctccctggggatttccgcaattcaggtttcttctgaccgcacttcccctgctccggccaaaccatgtcccgctccccatccggaccgtgacagccttcccgcgggcgcctgccggattgcagtccatggaaccggcgcctacctctatgggctggaaatccttccccaacatcgccagaaggggctggggacatggtttttatatcacatcatgtccatgctggcaggacagggctgccagtgcctgcgccttcaggtatcaggaaccaacgagccagcccttggcctctacagaaaaacagggttccgcataacggagaccctgtcctatttcttatattagtattagctgcctttgggggctgccgcccgttatcagtccctgcgcaccgtaacgccctgggcctcaatccgcttgcgtatctcaagcatcttctggtctgtctcggcaattacgtttgcgcactttctgagttcttcactgatttctccattgtcgtcaataaatgatttcttatacttcagctgatggtccaaactggcccagaaatccatggcaatggtgcggatctgcacctccacccggatcggcttcttgctgtcggagaaaaacacaggaatctctatgatcatgtggtaactccggtagccgttgggcttcgggttcttaatatagtccttgaccatgatcacggtcacgtcatcctggcgcaccagcatgtcggccacttcatagatatcatccacaaaggagcagatgatgcggattcccgcaacatcatccaggttcttttccattgattccagcgaaacctcaaaccctctgcgctgaagcttctccacaatgcttacgggtttcttcaccctggacttaatcatctcaatgggattgcgctggttcttcacagacaattcatcattgagcacttccagctttgtcttcacttcacggattgcgcaggtatacctcatcattgcctgctgaaactgacgcgcctggttcacccagacttccggtacctgtaccagatccggcacattgacgatggactgatgaagttcgctgttgggattcatgttaatgttcatattcatcggttcacctcattatctgttgctatttcatctcattcatcctgcctgatagcctcatgcgccgctgcatatggtgccgctgcgcatgataccactgcgtacgatgccgctgctcatgctgccgcatcataggcatcacattgtcccgactatctccactgcgtgttcaaaccacggcatatccagatactccacctgtcctgcatccaccatctgggcaatcctggggtcaatgggaatctgtgcaaggacctgtatgccgtgctcctttgccacctcttccacatggccttcaccgaatacgctgatgcgctttttgcagtcaggacattccaggtaactcatattctcaacgattcccacaatgggaatatccatcttcttggccatattcactgcttttgcaacaatcatgctcaccagctcctggggtgaggtgacgataatgatgccatccacgggcagtgactggaatacggtcagcgggacatcgcctgtcccgggaggcatatccacaaacatgtaatcaatgtcctgccacagggtttcagaccagaactgcttaacagcgcccgcaatcacaggccctctccagatgacaggatccgtatccttatcaagaagcaggttggcggacatgatttccacaccttccatggatctggccggcagcatcagcttgccgtccggcgaagtcatgacgccctcattgccgatgccgaatgccatggggatggacggccccgtaatatccgcgtccaggattgctgtcttcttacccttgcggttcatgctgacagccatcatggaggttaccagggactttcccacccctcctttgccgctgaccacaccaattaccttcttcacggagctggctggattaagcgcctccaggaattcacttttatcaacggtacggctctcgcagttggcgctgcaggaaccgcagtcgtggttacattcactcattttcgttctccttccaattcttgttgggctgtgtctgctaaaaagtttcaaacacaaaccatatcatgtacattataaaaccatttgaaactattgtccattctttactcaataaaatatacatgaaagtaaaaaaaccataccttttcctgtaatttttttacaaaattgtgaacttttaacaatatccccccggcttcatttacttttttgtgcttaaatgctaatataataatagaaatatgtgaaaattctgtgaacagatatatttttcatgccaacaggcaaaaggagcggaggtgcgccatatgaaggcttctacactggggatattccgccgcagtccggctgcatatgaactttacgctgaaaataatccggaactgaccaggatcaaggtggcggaacattacgtacgcaataaaggaatggtggatttctaccgccatacaacgaaaactgccatgaccgccgcaatcctggtcatggttgccacactcgccgctttatcaggcatcggtttcaggaccatcacccattcaacggcaaacaggtatgcatttgagtcctccctggacaatctggtgcaggagaatgcgtccattgaagagatacgcatggttgattacagcaattattatatttacgtggatgactctgtctggaatggattcacacagtcagaaaagtccgcttactgcctggcacttgcggattccttaaatgacgcctgccattcctatcatatattaggaagcaggaaacaggcccaggtctttttctatgatccggacgggaaccttctagcccagccgtcggaggacagcggggaacacacggttttacaataggattacaccttaaaaagcgcggaccatggtttgggttcacaggaaacccataccatggcccgcgctttttccttttccttcttccccatgcggatacccttcttttattttacaggtggcagatgaacctgccttgtgatagaataggttaaataatcaaaaaccacccaaaggaggacgcttatggattcacgcagcctgtaccgcaaactggaactggattttaatttaaaggacatgaaggacgactggagcttcatgtcccttgacaatgatttcatcttcccggaatttaaaagcaggtatatgggactggtggctgataatacagaacagatccggaaagtttatacagccacatttcccgacagggcaatcctggatgggatttttaaaaggaatgagacggatgtgctgctgttcgcccatcatgcaatgggatatattgcatccgatgagggttttccattccatgacattcccttggattatcttagggaaatgaaaaagcggcggatttcattctatatgctgcacacgcccctggaccagtatggtgaatattccacttccgtcagtcttgcgaaggcgctgggcctgcggattgtggaacccttctgccagtatgatggacatacccaggtgggtgtgatctgccagaccggaatgtcctccgtcctggaacttaaggatcaggtggcccgcacggtggggcatgacgcaaagctgtacccatacggggagccgaccatcaaggacggcagggtagccattgccgcaggcggcggaagctacccatttgtcattaccgaacttgcacagaaggatatccactgctatatcaccggattcaccaagcccctgccccactttgagccgaccctggaattccacaggctggccgggaaccatggggtcaacgtcatcggggcaacccactattccacggaaaagtttgcctgcatggccatgaccggatatttttccagggccggggttccggctgaattcctggaagggacctggtatctggaggacttataggcagttccaggcatatttgccgtccgtcttgtcaaacccgtaaaagtccgcaaaggaaaggcggaaaatgtcccggccggtgacaggcagctttatccggttcttaatcaggtactggtagataccgcttcccgatatgtcgcctaacagaaggatgcttttgaggattccatcctccaccagggccttcctgtaattgtgcctgtcttcctccgtgatgacctgggtgttgtcacccgcacagttgatatcgccgatacagagggcgggcaggccaaagaaattcatggtgttcttcatggcataggtatcgtcataaaccgtggggatgccgcacatgttcttggctgcggtcactccctgcttcattgcattgggccagatcccggacaggccgcagacatccccggccccatagacatggggaaccgtggtttccatgtactggttcacggttatggcccttccggtctcaatcttgcagttttccaggaaacggatttccggacggacccctgccgccactatgatgaaatcacattccagctcttccccgctgtcaaggatcagggcctgcacattcccgtccgcatccagacgtgttcctgaggccttggccgacagccggaacctgcatccatgggtttcaaacagtttctggtattcggctgccgccggggcatccagctgcagcggaaggatgcggtccgccatctccacaatcaccgggtttatcccctgttccagaagcgcataggcggcgtccatgcccaccaggccggaacctacgatgacagccttttttccaggccctgcggcatttttaaccgcctctgcgtctgacaggtcgcggaacccgaatacattgtttgcctccctaagccccggcacggggggaaccagatagtacgccccgctgcatatcaaaagcctgtcatatggtatcaatgtcccatcgtccagttcaaccgtttcttcatcacagtgaagccctgtcatggccttgcctgcaatccagtcaatgccctgggactcaaagaaacccggcggcgcaaagtctatctcctctgccgtcctctggcctcccagatatttgtgcagcatacagcgggaatggactttttcatctttggacaccaggacaatctgcccttcccggtccagctggcgcagcgtccttgccgcgctgatcccggctgcgccggctcctacaaccacatatctcatgactgcacctcctctacccagattgcctttttgggacatgccttgacgcagcttggctcactgccgctgtccttgcagaaatcgcacttgatgatccggcttttagtggtgctgtccggcttcagcacaccgaagggacagttcatcacacacatgaaacagccggcacagcgtttttcgtcatactcaacaatccctgtttccgggttcttacttaatgcgccgctcatgcaggagtttacacattccggctcatcacagtggcggcagaacacgggacggtaagtgccgtccggctgccggtggatgaaattgcggctctcattggacgggtccgccagattaaggtcatatatgctgcctttgtccgccctgtgggcattcatacaggcaagtgtgcagttcaggcagccatcgcacttgcaggcgtcaatccatattcgtttcatagccacccctcctatatattcagcgctttccgtttttcttcaatgatctgttccaatatccccgctgtttccactgcatcgctgttcacaatgacctggcctccggtaagggccttcatatcctgtgtaaggaccttggtcaccaggctgctgcctgttatgaagggaggaagccccagatgaaggggaagccccaaagccaggccaaaggcgccgtcggccagggcctgttcttccagccactgggcagcggagagcaccaggggaagctgggggatatccaccccaagggcggatgcaagctcggttgccaccatctccagcctgccgatggcaagacatggcccgaagttgagcaccggaggaatcccaagggactgacagacagccttaagcttcggtcctgcaaactctgctgcctcaggcgtcataaggccgcagttttccaggccccctgatgaacatcctgcggtaagtaccaggatgtccctggcaatcagttcctttgtcaggtccacggtcagcacatcatggcctccggctgtcaggttggagcatcccaccacccctgcaatccccttgatgtcgccggatgcaatcaggtcaatgagcggtttccagctgtcccccaggaacttcttcagggaaacctcgctgacaccggtaatggtattctggttgccgtggtccttaaggaggttaagggacacgatggtccggcgttccctgtaagaagccagaacatcctctatgatttccctgctgatgcgttccctgtcctcaaacacaaatggtttcagctgggcattctgcttcttcgccacatcgtccagacagatctgcttaatgtgcagtgaatcacagataggctcaattccgggaagggtgcagttaaattcactgagcaccgcatcaatggcccctgtggcaagcacggcctcgctggtgtagttgttgcccgcatgaccgctgaatatatcctggtaatgcacgccgcgcagctgtaaatcctggcccacgcaggtgcagcccaccaggcggaagccctttgccccggctgatctggccagttcctggacctccggcttcttaagctgttcctgaagatgcacgaaaatggagtgctgatggcctgttatcatgatattgatgtaatccgggtcaatgacgccaagtcccacgggggcaggcatgatttccggttccccaagcatgacatcgttgaggagattggtcagcatgagtccgtataccccggtggatatgccaagcttcaggcagtggagcagcatgtcaaccgggtctgaattcaggttggtggagcatttgaccacgcctgcacagacctcggatttggccccgccgggcaggatgccaagctccttccacttctcaaggcgcgggccgtaagccagcttctgctgcagcttcatgggtacgtaatccggcaggtataaatcatccagcacggcctgcgccacggcggcagcctcggtgtgcgggtcgctttccggaatcccgaagagtccgcacagatgcttcaacgcgttcatcccctttatctccccctttgccagggcggtctgtttcaggttcagggcagttgtctcaatcacatggatataacagccggatccggatgcaacggcgcgcaggaaattccttgccacgattacgtctgccgacgcgccgcagatgccatggggcgcttccggggtgatacggcagggaccgttggagcagaggcggcagcagacgccctgaagcccgaagccgcatttgacggactggccctccaccctgtggtgggatgtttccatcggaagtcctgctatgtatccttccaatggcttatctgcgcttttgcaggttgtacagctgtaacaattgttcatggtaaatacctcctgttgaagttttgaatggaactgtgggtttggattaaaagaataaaattatgtatatcataaagtggataaaaataatccactttctaaacaaaaaataaggttggtattaaaaaaggatatggaattcccggtcagcaaaacagctctgccagcgtcctgtgcttcagctcccgctccaggattgcctgtaccctggccagttcgcagtggaccgtgcagttatggccgctgccatctgcatactcacagcggtacccctccctcagacagggattaaggaaaaattcctcgtcggtggcgcgtatgacatccaaaagcgtaagcacatcaaggctttgtcccaggctgcacccgccgcctgctcccctgcggataagcaccagccctgctttttccagcttctttagtatcttataggcaaactgccttggcacctgctccttctggcatatctgcccaatggtcagctgctccccgtccttcagggcgcggatcatgcgcaccgcataatcggattctcttgttatcatcatgttcatgccgcctttattgttaaagatataacaattcatatgtaatattataccaaagttgacaaaaattatcaagtatgaaagtaatatttatataaaatgttgcttatcagcccggcaggttggaatctatacaaattatacaaatctgtagactgcattcaaagtccgggggacatcaccgcctttgtcaacatagatgcttctattgtaacgtataccgttcttcttaagacataattccaaaaaacacatgaaaataccaatatcaatccgattgtaaaaagacaccttatcagacggcatgattccacgcttaccagcttttttgtatctgtaaaccgccaaaccaaccgcattgcattcaaccatccacggctgtgtgttgcaggaactgggagcaaatcttacaatgtcagccacatcagccagcatatttcccgcccatatatcctctgcggtcctgcgtttgcttttgaacatgttctttcggaattttctttcatcatcaattttggcaatggcaatcatgatgacaaattccaggccatggattaaaccttcttccgcttttccaatcccataccataaagtgcctatgttttttgaaaccaggtacaaatccaactgcccgccgatatatcctatattctgaaggtaattgtctttcttctcgctgtacagcaggatacagtattcctgtccccgtttacacgttgtctcatttgccggcagcacttttaccgctgttttaatatcaggacacaacggtgtcaatgacggatatacttcttcaatttcccttatttcctcccaagaaattgattcatccccaatattcctgaaaagatggaatgattttcttttgaaaatcatttgataaagcatgttttcatctatcatgttttcctcatatattctcccctcggtggaacgggagttttatactacattataattttccaaccggaattactctttgtcataaacaaaatgttgattttcttttttcttatcatattctaacgcttcataccctccctgcagttcccgtaacagttcctcttcacttggcagatatagcttatactttgaggcaaaaatctatgtttcattttctggcaacgtatacctgactacagattcacttttatagcctttcaagctgtcgtgtactccaatttgatttgattgcctcttctgtatagaactgacgggcattttcattttccacacgtatcttatcccttttcgtaaactaattctgcaaactgtccatatttttttactgattccagccgaaagcgctttaattcctctttttgcgtaaacaaaggaatccctgtccccaataatacgggtgcaacctgcattataatatggtcaaccatgttattattcaacagaggtctcaatatcgtgttgccgccgataatccagatattcttgtctttgtctatctgttttacaaattccacaacatcagcatttatggatgtgaatccattttgagataaatcactggcatgggtaaaaacataattttgggtagtcggatagaaatccaaaatattttctgccttttctatttcattaaatgtccttttacccataatcgtaatatccatttgtttataaaactcttcataatctgtttccgttgtagtgcccgtttgataaagccaatctaaattatgggctttgtcagcaagatatccatccatcgtaatacagccataaaaatatatgctcatatctaatgctccaatcatctccaaattaaatattatacttcttcaacctcattaaccttaacaatttcatctattatttctttcgattgctgatgataacctccttttccctataaaaaggccagcaaaccaaccaccaatacctcctacggcaagcaatccatatggtgcagacatggcaggctttatttttccggcattcccatggtcctttactcctcctcggaacaaggcatagtcaaccgtttttctaaaaatagcagaccatgatatattcttcctcattctcatcaacaatttcaaatcccacttttttgtataatttcacggcatagttttccttttgtacagcaagtgatgcctgttgatatcctcttcgttttaatatacaaagcatttcctgcattaaagcagtaccgattccccatccccgatactctttatacagggaaatggcaaaggaaggtgtcgcatcatctatatgtccgtaatcgttcataatacggacccagacagcgccgactacttttgtgccaacttctgccaccaaagcaatgtcgtcttttttcttcccaaaatccgttacatatacctgtagctcaagctgttcgatgattgatctcagcggagcgggtacaccgataatgtaattcatggatacctccaagtctgttctgacagttcagcagaccggactcgtcagcgatatacgatatagcggtaatgcggcatatcgacacctttataatattttgtccatgtgtccgtcattgtcataccgttccttatggctacattttgagatgcaacattggtatctctgataatagagcagacttcatccgcttttaatatttcaaacgcatactttttacaggcctttgccgcttcggaagcataccctttatgccagtatagccgttcaaaaagataaccgatttcaagcacttcctcatctttccactgctgcatcgtaagtccacattgaccaatcatttcatccgtctgtttaaggatgacagcccataatccaaagttccatttttgataacggaaaatttgtctatccaaccattcctgcacttcagtatcactaaacgctccttcgtaagcgtacatagtttcctcatcctgtaatatcttgcataaagatttgaaatcagactgattcatctctcgtaaatacaacctctccgtttcaaatatcatatcatccctcaaatttcaaattttcagctagtgctccatccagtttactatagtttagacaaagcgtccatatcaagtgtctttttcaacctgctttttcggtctcaagtaagctaacggcagccttttgttccgtggtataggtttttccaaatcgtatgacttttgccaaaaagtaagggttttgccccgtagtatcattttactgataaccacatggcaaaagtatttccattacataatggtggggtaaatttcttcgtcaattttacccatcttacattacactttctctaaagtaaagttattttgatttttctttatcatattccaatgctctgtactctctttgcaattcctgtgacagctcttcttcgcttggaaggtatagattatactttgacgcaaaaatctgtgtttcattttctggcaatgtatactttactacagattcacttttatccgcacaaagtacaattcctatcggtggattatccccctcattcatcaattcacgttcgtaataatggacatacatctgcatttgccccaaatcctgatgtgtcaaatctccgatttttaaatcaattaatacaaaacatttcaaaatataattataaaaaacaagatctattcggaaatgccggccatcaaatgtaatcctcttctgtctggcaacaaaagaaaatcctctccccaattctaagagaaacttttgcaaatgcgttatcaatgcttcttcaagatcactctcataaaaatcgtcttttggattcaatcccagaaactctaatacgtatggatcgcggataatatcctctggtacttttgcagcctccaatttctggatttcttccgaaactttttctttattttggctggataacagcctttcataaaagaaagaattaatttgcctttccaactgccgtgtactccaatttgactttattgcctcctctatatagaactggcgcgcgtttttattttccacacgcataagcaagcgataatgtgtccaactcaattcgctacgcagtgcgtagctttttggaaatgtaagataaaactggcgcatatttttaagatttgcaactgtgaatccctttccaaaatctgtagtcatctgtttggatagttctgctattaggcggactccatattccgccttttcctcaccgccctgctgttctacgatacttttccctatattccagtacgcttccaccatcgcaaagtttgcagtttgatataccttgtttctggcttcagaaagaattcttttaatctgctcataaaattgttgttccatggctcctccttctttcaattactgttgtgaaaataatatcataattttatacactcatccaaactttatataggcaagtgatatctccatttcaatatcatctagtttttcccatagtattttttataaaacttttttgagggtttccagattttatgtaaatgaaacgtacaaataataaatccctgcaatctgtctgcagatggacaacagggagctttcaaaaaaattcgacggaggcgatgcttcaaagcggagactggtcgtcacaagggcaaaactttcgcagatggtttcatcaggccaaacctgttccccatctaatcctttgcccagaatgcaacgctatccatgtgcatccaaaggggctgccctgcgccgtcatccccatacatattctctatgatgcaatccaggtcctactgcccgtcccggtaatgggccttccaatgttccatggcaatcagccgctccttttaagggcaggaatgaatcctcaaacatccccaatcccctttcttaccccagttccgattcagctgttcaccgcgttcagcagatactccagtgaaaacgccttccccttcgccatccagtcctccaggcgtcccttattgatatctgaatgctccacctcccttgagaagcggtgggcaacatccacaaaatccaggaattccagctgtctcccattctgctgccagacagccagcgccagttcctcaattaacagggtgcaggccgcagccattttcattttcctgaaaggactgttgttatagaccgcgccgcagaaataggtaaatacaaagtaaaccatgagctgttccctccacagcggcagtttctttcccgccggaccattcaggaacgccgtcctcatttccccatacacagtctccccttcaccgtacagggtcctgtccgcccggctggcaaagtccggccagtcctgtcccaggacctccagatctttaaaaatcccgaacatctccttcacgatgccataacgcgccacctgggtcatccggtaatccgccagtttcctatggaaaaatccgtcccgctcctgtatcgcacggtaatcatcactgctgcctgcgtaccgcatgagcagtgcatccgcatcaaacaggcgcccctgccgtatgcgccgctccaggtcatgggccagtgcaaggcatatggaaatacgcatgctgatgtccattgacctgtcctgcagtaaggacaacgccagctcccgtgtatccatcagctttgtataaaggaaaaaatcaaaatcttcataagattccgccttcccgtcctcctttgtgatgaaccgcaccggctcctcacagcccaggataagctttgccgcctcaatgcaggacatgcacagggatatttccctgcatccctcaaactcctcaatgtgtcttggataggtgcggcaggtcctgcaaaggttctctggccctgtctcggcgtagatatcacagaggttttcttcatttaaaaatgcacacctcccctcatactgcctgaatgaggcttccttccagtcaatggagttgtgaaggcggtttccaaatgggcctttcatctgccggtagttctccagcgccttcctgtcaatcatgatggcccacccggcgcagcaggtatccgtacagccggatgcgatgcaccggaattgtttataatagtgcgggattgtgtatatcattcgcctctcctgccttccagctccagaagcattttcttcacatccatcccagccgcatagccggtaaggctgccgtccgcccccatgacccggtggcagggaatcattatggatatgggattatgtcccactgccccgcccacggcctgggccgacatggtgggccttcccagtaactccgccactttcctggcgatttcgccgtaggttgtgcttctgccatatgggatttcacataatatcttccataccatctgccggaacgcgctgccctggggttcaaggcttggaaggaatccaggctccttgcccttaaaatatgcatccagccaggtccttgcctcatcaaacacgggaagttccgctttttcttcatacagacccggaaccctttctgattccttaagcttccaccccccgccgtcaatacgctccagcatgttacggtccagcgtgcttccataatatttctgtccctctatccacaggcctgttatgctcttcccattgctggaaagggtgagaagtcctgcgggggaaggtattttacatatgtataccatataaaccattctccttttcttctatcatgtttccttccgttaccttatccttatctgagcttcctcacaggaatgtattctccctgacacctggaagcaggtcataaatcccgcatcccatccgctcctcaaaatactccttgattcccagtatcttcttccatctgggcactgtggaggggtgcgtcccgtatctaagggtcacgtccacaaaccgcttctccagaaggcagaacccgctgggcagggccagggaatcgcataactgcaccagacggtcataatcatcatacaccgctgattcgatgaattgtttcatgaactgccggtcctcctcaggcatatcgaatacgccgatggatgtccctatgtcctgaatcatgaaggcatggctgatgcagattttagccgcctcatcccacccatgctccatgcatctgcggtatccctctatcaggtggcgttccgatatccggcccggaaaccggcccacgtcatggagaagccccgccacgtaggcgtgttcgttgtcaagccatccgcaccgggatgcaatatattcacaggccatggccacatatctggaatggtccacccagattcccggattctgttccccggcccataccagttcttcctcagcccgttttctgtctggcagcatgataaacctccttgttgtatataccagggtgtgttttcattttcccaatatctctgttcattgtactaccaaaagggatgaagggctactctttttattgtattatatccctgcctattatatccctgtgttccataccatatggacatgcggatggcaggaatggattttcaacatcccttaacacggaaaaagccgccggacgtcccaacagacggcccggcggccatatcatcatatcatcagacctgcgggaaccctttattcccccacatagtactccttcacctcatattccctcagcgcctcttcatccggctcaaatcccagtcccggcttctggggcgcatgcatgtatccgtccttgtcaatgagcacccggtcctcttccctgaggatataatcccggcgttccacggtccacaccggaggatcaaacgggtattccaggtactgcgcgtcactgaccgcacaggccatgtggaggttggccagaaggcccactccattggaccaggtgtggggacagaatacggcgcccttggactggacataatccgcaatcttcctggttcttgtaaatcctccgcataaaaccgtatccggctgatatacatcgtagcttcccctgtccgccagatcccggaaatcatgccatctccggttcatttccccgcccgcaatcctcaggctggtcatctgcctgagcctggccagattatcgtagtccgcatggtgcaagggttcctccagccagtatacgtcgtatttttccagttcctttgcaaccttaagggctttcttcaaatcccatatccgctccacgtcccagggcatcttccaggcctggttgccgtccaccatgatttccatcttatcgccgatggccttcctgacttcctccaccaccttgatgtcctccctgacatcctcatggtggaaacggattttcatggccttaaatcccatccccacatattcctttgccttttctgccctctccccggcgctgatgcgggcgccgcaggaacagtaggccctcatcttatcctgtttcccgcccagcagtttgtagatgggctggccgcatttctttccgatgatatcccacagcgcgatatccaggggccagcacctgccgtaatggaaatcaatattgtcaatcaccttattatggttctcgatttcaaagggatccttcccgataaaaaacttctcatggcctgcaaatccggtcatcagatcaccggagccaatgcctgttatgccttcatcggtgtggacatacacaatcgtggacgcaaacttcacccttggattggggtcccatgacgccaggaacggcgggtacagcggctttgcgtactgtttgatctcaatacctgttatcttcaatttttatccccctcttcttccttctttgagtaaatatcatatttccccgggttgcgcatgattttcagcagggccgcacaggacgccatctgcaggaacatggaaggaaatcctccgatgctggccagcgtcttggcgccacccacgcccgtgaataccgccatcacggccgccatggccccgattatgacgccccacaggattttcatggaaacaggcgcctccatctgttcctccgacatgcccgaggtgcacaccgacgcaatggcattggtattggagtcagccgccgtgacaaaggaaatgaaggtggccaggacgaacacaggcacacacagctgccgcaggggcagtaccccaaagagcttatacacaatggactccgccccggaggtttccaacagtggaagcaggctttcctgcatatgcatatggatggacgtgcctccgaagatggcgacccagaccatggaaaatgcagtgggcacaaacaggttgatgatgatacagtccctcaccttatatcccctggcaagcttccccaggaacagggcggtcacaggggcccacgccaggtagctggcccagtatcccaccttcatgttggcaaggctggaccaggcgctgtttcccaggttcatggaatccgtaaacaggttgcgcatgaaaaatgaatccagcatctcccccacggattccatgccgaagttcaggatgaaacgggtaggaccgaacacgaataggaacaggatgaggaaggaaaatatgtacacattgaaactggacagccatttaatccccttcatcagtccagaggacgcggaaatcgtatacaccaggatgatggctgccatcacaaggatgagcatcacgctgctgttggggattcccgttatattggaaaccccgcctgccacggagaatgcacccgtggacagggaacccgccatgcctgcgcacaggatgaaaatacacagggcgtcaatggcatctgaaagcctgcccttgatggcccgctcaccaaccagcgggtatatgcaggcgcctaaggtaaagggctttttcatattgtagtacacgaacgcaaacacggttgcggccagggcatagatggcatacggggtaatcccccagtgcaggtacatctgggccatggcaaatacggctgcctggggcgaatccggctccaggccgaaaaacggcgatgggtcgctcatcaggtacagcggttcagcggcagcccagaacataaggccggccgcgatggtggtgcacaggctgatggcaaaccagttgaatctgctgagtatgggtttggcatcctttccgcctatgaccgtgtccccgaacttggaaaaacaggcgtaacagcagaccaccaccgccaccatcccatatccggagaaaagccacctgaagttcccccatatccagtcttttatatgattaatgaatttcaggaatacgtcctgggatacgaatcccagaaacagtaccagaagcaataccaggaacggcggccagaaaacccatttcctgagccttcccttcttatcagtcttatctgtcatctatcttttcctcctctttacaggatgcgctcctgtcagcatgatccccgtcacaatggtcccaagcaggatcacaacaattgcataggtaaacattctataatagccgtccattcccgcatcaatccagttccccaccatgctgtacatgaaggtatccggcagatacccgatggcggccacgataccgaccgttcccccgatacaggaggaatcaatggaattctctgaaatcaaggcataatacagccccttaatcccatagacggcaatggaaaatgcaataaagccaaaaatccccagcatcagggaagacatatcatagggctggatgatgaataccaggatggaggccagcatcaggataaagcccccgaatatgattttatagccggacctggcccggtccgccagatagcccgccaggaccgcgcccacaatctggattccgtaacgccatgtggaaaggaaccggctgacctcgatggaggaattgtaggctttcaggaaaaacggcggcacaaagcttaaaagtgcgtacatggaataccccgaaaacacaatcaggcacatgatccagacccttggattcaataccacatcccgaatctcctgcttcagcggaatggtgcgctccacatggatgtattcgtccggcacgacaaggaccacgccgatgcccagtatgatgttcaggatggcatatgccttaatgacccattcaaacccgaaccttccctcccccagcgcctgaaacagcagctggatcacaaaaaaggtcacgcctgcgaaaatccccttcccggcctccatccatccaaatatccgcccctgttcgtatctgcctcccaggttcttgaggatgcggatggatgtggaaaaaaaggtcatgaccgtggtgatccccataagggcaaatatgattttcagttccccataatccggaaaacgtgagaaccagaacccaaggatgcccgtgcctgcaaagggcaggaacaaaagccacctggaattcagccggtccgaaagaaaaccacccgcaacatacatgaccaggctcaccgtggaatagatactggaaaggaccccgaattcctggttgttaaggttcaatgcctgacagatgggcacatagaaactgtttctgatatagggcagctcaaaaatcagggccaggccggataccagcaccaggaacgtgcttattttcttaaagctgtcattcatatcgttcactcctttgcgtctgacttctcgaaaagctcatcctgggcctggctcagatacaggtactcctcatatggaaaatgaagccgtatgatggttccctcccccagcacgctggatatcccaatcctgccgtcatgggcctggataatggactggcagatggaaagccccaggccgatcccattctgggaacggctcctggatttgtccaccatatagaatggttccgtcagcctgtccagttcctcctccggtatgcctatcccaaaatcccgtaccgatatctcctctacagcgccttccctggtaaccgcatccactatgatacgtgaatgttccccggatgccttcacgctgttatccagcaggttcacaagaagggttgccagcaattcctcatccccgtacatataagcatcgggcctgttcctgtattcaatccgtatatcccgtatttccgcctgggtctgtatggaaatgcacgccatattcaccacctcatccagacacacccgctttttctccacctgtctggattccacaatcaggaatcccatgatcttcttcaccagggaattcagcctgcgcgcctgcatcaatatataatccacggcctcctccctgcactccccggtacaatcataggatttcagcatgtccgcgtaaccgatgatggacgtaagaggggtttttacctcatggatgaaattgtcaatggcaaatttgtaattgcggatattgttttcaatggcgccgcacatgatattgaaattcccggataattcgttcagttcatccgtgcccgtgaccggaagccggtatgcataataattgtttgagactatctttaccgcctcatttatcttcttgatgggaaccgtgatgatgagggaggctgtcagcatgataaaggccgagacaaccgacaggatgccgcacaggaggaacagggtctggagctgggcattgcacctgccatacacatccgacaggtccctgaccagcaccagccttgcctcctccccgcccaaggacaggggttcctctgcaaacaggtaattcaccttattgatggctactatctcaagaggctccctctttatatcatagccaaaatcatagcgcaaaggctccggctccagtccgaagccgtcatataccttctcctgtccgcagaatacctggaagtacgtatcctccggaatcaggggattcccaaatgccgcaagacagctgccggacttctgatacgccgcctccgcctcctccttcatccggcccgccatccagacagcctgggcttcctccgactggaggttccgcttgtgtccggaaaccgtggtaatgataccgcagacagcaaataaaagaatactggcaatcagggaactgatgaaaattttctgccataatttcattttataaatcatttctgccctcttttatcctccaggatatatcccacttttgtcacggtcctcagctcctcattcagcccggcctttttgcgcagacgctggacatggatttccacggtcctgctgctttccaggtattcctgcccccagacgtgggctgaaagttcctcccgcctgattaccttgtcctggttttccataaaataccgcagcagttcaaactccttgggcgtgatttccagctccctgccgtccttatgcacggcgtgccggtccacatccatcacgatatccttaaattccagcttcccgcaggccctctctgtgcgcctgagcaccgcctcaatcctggctatcaggtccgcgctctcaaagggcttggtgatatagtcatcggcgccggcccgcagcaggcgcacccggtccacaaggctggattttgcagaaaccacaataaccggcagctgcagtttcttgatggactcaaggaccatttccccatccacatgcggcagcatcagatccaggatgaccaggttatacttctcctcctccagcatcaccagcgctatctccccatcctgggcaatgaccgcctcataacctgcaaaggagacatgtgtctttattaatctggcaattgagatatcatcttctattatgagtattgttttcataccacaccccgctattttcagattttagtctaattataccagataacaatacaattgtgggacggaaccatcagaaattccgtcccttccttcacagcctattacttattgaaaaactccttatacctttcatacacggcctccatggcttcttccaggacgcttctgctgcacgccacattcagccgcatgaagccgtccccggcagccccatagatactgcctttgttcaatgccacgccagccgagcggaaaaatccatccacctggtcgctgtccatatcccagccatggaaatcaagccacatgagataggtggcattgggcttaaccatcctgacctccggcattttttcttccaggaaatgtttcaggtacatgatattatcccacaggtatgcgttcagctcatccgtatacgcatctccgtgttcataggctgcaatctgggccggaaccccgatcatgctgaaatcaaaatgatggtttgcatacgcaatctcaaaggcatcccgtatctgtctgttgggaatgatggcataggacacataaagcccgttggtgttaaaggtcttgcccgccgagttgatggaggcgctgttcatggcagtttcccggctgacgcagatgaacggcacatgcctcgttccctggtacaaaatgtcgctgtgggcctcgtcgcttaccacaaacacatggttgcggcggcagatttccgccacccgctccacatcctccctgctccaggcatgggccaccgggttgtggggattgcagaatatcatcatggtcgttcttgggtcagccgctttcctctccaggtcctcaaaatcaatgcggtatccttcattttcataaatcagggtgttctccagtatattccttccgttcctgctgatgatgagggaaaagttgaaatacacaggcggctggatgattacattatcccccacatgggacactgcctccatgagcatcttgattgccacgatcaggccgggcgaataggtaacccaatccgcgtccacatccgcatcgtgccgttttttgtaccagcgggaaacagaatcataaaatgcctgaggcatcacgccataggcaaagttgccctgggcggccttcttcatcactgcctcagtcacttccggcgggggcaggaaatccgtgtccgccacccccagcgggtaggggcattcctttccttccttgtcccatttccagctgtccgtacccttcatatccttctgctgaccaaaatcatatcgtcccatatgccatcctcctttaatcattccctgtcttcagggatttgccgtatctgtaaatatagaatccaaccccggttgcaagtaccaggaacacggttgcaagaatgaagatgtaacggtatccctgagcaccgggcaggttgtcaagccatccgcccatgatgttgaagatgaacatgtcaggcatgtaaccaagaacagagatcagaccggaagccgcgcctgtcagcgcaagcggaatgcctgcttccgccatgggtgagaaatagattccccttgcagcaaataccacaaagctgaacagcagggtaagggccaccggaaccatgaggaactccggctttaccggggtcaccaggtacactgccatcagcgcaacgccaaggatggatgcgtaggccagtgtcttggagcaggatttaagcctgtctcccagaaagcccgccaggggagccgccacaatgccgattccatatgccctgatgatgctgagcgtgctgattgcaacagaggaaacaccgtaaacattggtcagataaggaatcgcataggatgttgtgcagtaaaccatgtaccagcagaacaccagcgcacacacaagccatgtgcctttatgcttgaaagcttcaaccagatcccccatcacaaaggtcctttccgacccggtctcctttgggttcggaagaaggatcatggtgatgatgccgactgcaatgtagatgacgccatagaatataagggttcccttcattcctcccacctcggttgcagccacctggatgatgcccatgacgatgaagctggctatgatgccgctgatgccgcggataccctcggcaagtccgaacatgcggccctgttcctcgtcactgcccagggaacgcactgttttcacaaatgcggaccagtatgtaaggatggtcgtaacgcccatcagcccgaaaataaccttaatcataccgaatgacggcatggtggagcaccacaatgacagcaccccgctgcctatgaacgatagggtcagcagctttttataagataccttatccgccaggataccgcccggcagatagctgatcagggccacggtcccgtagatggagctgatggtgccaagctgggtattggtaatctggaatcccgacaacatggcgtcataaaatgcctccctcatgtaggcaaccttgtaaatcacacccgcccccagtgcaatcacggtcagaagaaaatactttttgaatgtttcacctttcatacatttcaccttccctaattattattcagcattttcacatccgtatatggaatgtttaataccctgggcctatattagcagttattacctgatccatgtggttccgtagcataatattatctattttgttgcaactttgatgcatttccagaaaatgtatgggttttattgatatcagacagccccatctcctgcttcccatccggcctggatcctgatatgattataagtatcatgaacaaacagataagctggggcatgtttaaaatgcctcaggaaaggagccactgcatgagatacagaaaactgggcggcacaggacttgaggtaagcgagatcggactgggggcggaatggctggaacgccatgatacagaagaggtgaggcaggttgttgcctattgtgaggaaaagggaatcaatatactggactgctggatgtcggagccgaatgtccgctccaacatcggggctgccatcaggggccgcagggagcgctggatcatccagggacacctgggttccacctggcaggacggccaatatgtgaggaccagggaccttgagaaggccaaggcggcatttgcagacctgcttaaacgccttgggacggattatattgatctggggatgatccactttgtggatgaaattgcggaataccacaggatcatggacggggagttttacgcctatgcaaaggaactgaaggagcagggcgtgatccggcacatcggcatgagcacgcataatccggctgttgcaaagctggcagcggagagcaggcggattgagatgatcctcttcagcatcaatccggcctttgacatgcttcctgccagcgagaacatggaggattattttaaggaaacttacgatgagcagttaggcgggattgcgccggaacgggcagaactgtacaagatttgtgaaaagaacaacatcgggattacggtcatgaagggttatgcgggcggacggctgttctcagcagaaacctcacccttcggcgtggcgctgaccccggtacagtgcctgcattacgccctgaccaggcccggggttgccagcgtgatggttggatatgataccgtagggcatgtggacgaggcggttgcatacgagaccgccaccgaagaagaaaaagactatgccaccgtactgtccaaggcgcccgcccatgcttattacgggcaatgcacctactgcggccactgcgcgccctgtccggccggcatcgacatcgcgatggtcaataaattgtatgacctggctgtgatgcagccggaggtccctgccgcgctgaaagcccattacgatggactgtctgccaacggcaaggactgtgtcggctgtaagggatgcgaggaacggtgtccgttcggggtggctgtggctgaaaggatggaacaggcggctaatctgttccggtaattccgtccgggccagccctttcataatcctcttaatgatggccgtgaagcctgggcacatctacattaataaggcacaggcagcccgggattcaccgccatcagatatgtatacacaataatcagcaggataaccccggcggacacaacgatatacgggatgattgcttttgatatcttttcaatggatacgccggacacgccggacagcacaaacagcaccatccccaccggaggcgttaccaggccgatcaggaggttcagtaccattatgatgccgaacatgaccgggtcaatcccaagcgccgtgatgaacggaagcagtaccggcgtcatgatgacaattgccggggtaatatccatgaacaggccgatgaacagcagtatgacgctgacaatgacaagggccatcatcgggttatccgtcagattcattaaatataccgccacggtctggggtatctgtgaaaatgtaaggatccatgaaaacagtgtggccgatgcaatgatgaacagcaccccaaccgtcacatccaatgtctgccggattacggacggcagctccttcagcgtgatgctcttatataaaaatcccagaagtatcccatatacaacggctatgaccgctgcttccgtcggcgtgaaaatcccggcaatgatccctcccctgatgattacaggaagaagcagcgcccaaaaagaccatttcaggcatttccatatttcttttaatgtcgcccgtttccgcttttcatagcccttgttcttacagatgcaatagttaacagccatcattgcaatagccagcaggattcccggaaggattcctgccgtaaacaggtcccctaccgatacggaagcagtaacgccgaaaataaccagcggaacgcttggggggatgacaggtccgatcagggaggatgcccctgttactgccagggaaaaatcatcatcatagcctccgtccttcatggcctgcagctcgattgcccccagtccccctgtgtccgcgattgcactgccgctcatccctgcaaaaatcacgctggccaacacattggaatgtgccagcccgcctgtaaaatgccctaccagatggtctgcaaaggagaatatacgctttgtgattcctccctggttcatgatatttcccgccaggacaaaaaaggcaacggccaataagggaaaggaatccacccccgcagcaagcctttgggcaatcagttccaacggcagtccatagaccaccatatatgccaccgagctgatgaacatgctcatggcaatggacgctcccattaacagcagcaggaaaaaaagtccaaataaaatcagcatccgtctttcctcctttgcagtattttcctgatatcactgacaatcatgcccatatcgtatgccatgtaaatcacagcccccactggtatgaccaggtagaccagctgcatgggcagctccattgcagttgaaacaacattctggtgggcaagaaactgcagggaggtccgaaacagcactatgaatgccaggaatcccgccacatccacaatgagtccgcagagcgccttaaggaccggtggcagcctgtccttaaggagcgtcatcccgatatgggaacctctgcggatcccgtatccaataccaaggaatgtaatccatatctggagataccttgccagctcctcagcccatttgagaggagccgaaaaaaaggtgcgcatgataatctggacaaacagaacgattcccatcacggcaaggcacaatatcaaagaatattcttccagtttatgtaagccactaatcaaccttttcataacctacctcattcaacggcgcgtatcttatcaacaagttcctggtcaaaatcatcatatatgaacgccgtcatttccctgaatgcttctttgtccacatcgtcaatgatttccataccgttgtcctccagctgccggatatatgtatcctcagcctcaaatgccttatcatcaatccatgccgacgcttccctggcagcctcggttaccgccgtcctgtaagtctcaggcatggattccagtgtctttgtgctggcgtaaagggcattggcccccataatatgctctgtcttaataaggtaatgctggacctggtcgaatttattggcagcaattgtggccagtggattctcctgcccgtcaatgaccccctgctgcagggaaaggaagacttcgctgaaagccatgggagttgccactgcccccattgcagtcagggtgtcaatataaagcttctggtccggcacccgtatgttaagccccttcatgtcttccgggccggacaccggcttgtcttttgttgtcagatacctggctccatagtaaaatgccccgattcccctggctcccatgtgttcttccatttcatcaaacatggaatacaccgcatcgctgtttaaaatccgtaccagatgttccctgtcatccgcaatatacggagcgtccaggattcctatgtcctgatactttttcgccggttccccaaatccaatgattgcaaagtcaatggagccgatttccactgcgtcgaatatctccttttcattcccaagctgggaagcaggaaacacactcacggtcacatgaccatctgttttttcctttacaagccttgcaaactcctccgcccccattccgttcggatggtcgatgggcatgatatgggccagcttcagttcggcgtgataatcgtttcctgcttccgcagcagccccgctggttccggccccgtcagccacggcgctgccggaatctttccctgcgctccctgccccactgcctgccgagccgcaccccatcagtgaaatactgcatgcgcaggccatgattcctgccgcaagacgcctcatatgtttcttcctccatacatttaactgctttgacataaaccccttctcctttcatatttattgattcattttttccaatttctcccaatcaaattccactccggttccaggcagatccgacggttccaggtatccttccctgataatcagcggccgcttcgtatactgccagattgggaagctgtggaactcaatatatcctctgttttctaggcctgccagtatgttgacgtgcagctcctgcataccgtgtgagtggacctttaagtgatattgtccggccagcccggccacctttacaaatccggtaatccctcctgcattcgaggcatcgggtatgggacatttgatgtgtccaatccgcagcgccatctcatgctcataaatggtgtgcaggttttcccccatggcaatgggtatggatgtggcctgcccaatccttgcataagcctcataatcatccggatccgtgggttcctccagccacgtgatgcggaactcctccagacgctttgccatctcaatggcagtcacttcatcccaggccatattggcatccaccatgaaaacagccttatcccctatgaggcggcgcaccgcccgcaccctggcaatatcctcatccccatcctgtctgcccagtttaatcttaaatgcattgtgtccctgtcccatctggccttcaatctggcttagcagctccttctccgtcagcattaagtcaataccgccatagtagacaggcactttcgatgatggattacctaaataccctgacagacccatccctttctgtttcagcattgcatcccagaatgcaatatccaacgcggaaatggcaaaggaggcaatccctcccctggcaacatagtggattccccgcgccatcatctggttcatggtttccgggcactgcatttcttttccaatcaacaggggcgttaagtccttctctatcataaccgcaatggccgccccgccaataccgcccgtatatgtatatcccaccccctttactccgctttccagcatcacttcaaccgtgatgacttcgaaaaagctatgctttccgtggattgcatccaccagattaccttccagcggcagtctgaaataccttgtatcaattgatatgattttgccgtacacctgacttctcctttcccagccttgaggagcgtttaaaaatatatttccgccgctgcaaaggccatcaaatccggaaaaatatttatgtattttatttttcctatatttttatattattgtatactataatatcaaattaatcaagtatttttgtatactattttgaaaaacccaatacaaagcattctgtcctgctatattcagtccattttttaacactagacgccaaattatttttatattttgctcttttatgtatacataaaactcgtccaattcattagtatgttttatttttatgtatacaattttcttttactgagttaaaatagatttatccattgaaaaggagatagcttatatgcccaggctaaaaggaaatgcctccgacacggcattaaaaaagattgtccagaaaattaatgattatgagttatcctcaggcgaaatcgtatccgacctggaattatccaatgagctgaatatcagccgcaccccggtcagggaagcaatgcagcagttaattgatatagggttactggagcggacagccaccaaggtggtggtaagatccatcacccttactgatattgtggaaatattccagatacgggaagcaatcgaaatcatgagtgttaagataatcctgtccaacggaggattaacggaagcccagaagctggaactgatggatatccatcagaatctgtgtaatgacatttcaaatgggaacttcgacaaaaacttttccgatgacacggcgttccatgagaagctgatagaatattccggcaactcacgtatggaagacatatccagacgcatcagcctgcagagccagagactgcgctggctgacccttcttactccttccagatacgcaggaacacgggatgaacacgaacggatcatccagggtattttaaaccaggatttagacagcactgccagggccatccaggaacatctgcagggcagccttgaaaactatacccagatacttaataataaccaatggatgaaaatcatgagtgaacttaagaatatgaacccgtaaaggaacccccggaagccgccctgcagaagcacaaaagtggcaggcaaagtgtgtaccactttgccctgcctgccgcttttaaaaataacgatagcgtagtgttttattctcataatatcatcactccggacccccatttcatcgttccccgccctatctgccaaaggcaatccgaaaagccataccaagcggaattcattgaacagcatccataattggtgacagggattcaaaattaatgaaattgactttcttaccgaatgtctcaatcattgctgttatttcagcagttttcttttcttcaggcaggctcttggctttcctgtatagcaacgtcatcatggttttatgcttaaagttcagtttgccataatcaatcccacctcgcagatgaaatacctgcgtgttcttaagaattttctcaggtacttgtttactgatagacttttttatattgtccgtattttctttatcatttacatccgccaatccgactgttacgataattaatgctgtatcatcgttcattgccttaaccgtctttctcaaacctttcactccgccagcaaataaaccgccaaaatgtatgataaggccgtagtctgacaatgactgcatatcctcataattcatgacaggaatacctgtcatctctgaaaacctggatgcataagtccttgtcgttccatatccgctaccgtaaataatcagtttcttcatctgttttcctctgcaactttcaattttcattactgaaaatcaatatcaaaccactactgattcccttcaacaacaatgtggggaccggactttgaaatatggtccatggtgaaggactttcttcccaccacaggggagcgccctactgaaacagcctttcatttgagggacatttaagcaggctgcaggtttgaaaaaattgtgcgtctatttcgctaatatcatgtgccggcttctcttaacgttctcttaacgtcatctaggtatgctatatactcatttccccacacttcaagaacggataggacttttctgaatttttcaccgatttcacttagctgatactcaactttaggaggaatctgttgatattcaatgcgaacaatcaacccttcgtcttcaagcgtttttaattgccttgataaagtggtatgtgtcatttcttccggcatacgtctttgcaactcattaaaacgtattggcccgtcagttaatagatataggatatacatagaccattttcctgtaagtaccttttgcgcggttacataagggcatagcccgaacaattccttttttgccatgtatacgttcctttctgatactggtatcattaaatatcgtacttgcattatcactcctgcgctatataattatacttgcaaacagaaagaaacgcaacccacaatctgaaaggagtttttatcatgaatgaagttttggagtatttgaaatcatgcggcactttttatctcgctacaagtgaggatggacaggctcatgtacgtcccttcggtgcggtctgtgaatttgagggcaaactctattttgttacaaacaatcagaaaaaggtataccagcagatgaagaaaaacgggaaagttgaaatctgtggaatgcacaagggtacatggatccgtgttgagggtgaagtgaaagaggacacgcgccgggaagcaagagtgtccatgatgcatgacaacgaggctgctttaagtagcatgtacactgtcgacgataatctaatgaccgtattttattatgaacatggtactgcttccatctattcatttacctctgatccaaaggtaattgaactgtgattaaatcataaacagcaacgccggacagagcattttagcctcgtccggcgttgttcaaccatgcgcttttcagctgatagggacgccgcaaccagctggaaaaacaactatttcttattcttcagccgcagctcaatcccccgttccccggccatctcctcaaacatctgcacggcccgggcagcccgttccttcacattcccctcttccacaaccgtctgttcccggatgcgcccgaccacagccttcacgtcttcaagctccagcaggttgactgccagacaataaaaattcttgcgtcttccgtcgttacaatattccagcagccaccgcagcaggccaatcttctcatccaattcagcccgatatgcatttatcccgctcattcttaccttttcaaaatcccttgtcacattcctgtatgtaataaatgagtcctccggatgctcatccacataccgcctgcagggaaattcctcacacagcacacaatattccaccccgccgtggcgttggccgcagttgataatggcgcaggatggatgcttgaggtaaaatccctgcccgccgcatcccggacatctggatctgccctccgtgtgataccgcgggcaaaggccgcagttcaggccgcaggccgcgtattcagggtaatccctgtaatgttccttcatagctgtccccctcccttcgtcatcccatgattttctccggcctgaatttcaggtaatccgctgaaaccagcctgtactcaatcccatccacctcgcccaggaagctgtcctgataccgggcctccccgtggcagtgggaataaatcaccatctccgccccatattcctctgccatccgcgtaaagcagctctccatctcccctatgctggtgggcggataatgcaggaacatgatgaaatgttcatatccatccgccgcagccgactcaaaggatatgcgcagccgttcctgttcacgtttcacgattttctgaaaatgttccggggtgtcctttccctcatagcaataccccttggttccaacaagggcatggaccaccttggaacaatcctcataggtataatagttgttctgcaggaaagacagctttcctttatacagttcatttagcagacgggtctttttagcgtcccagaacatgtcatggtttccgcgcaaaaggattttcctgcccggaagggaggcaatgaatcccaggtccgccctgctctcattcagattccgcccccaggaatggtcacccgtaataacgaccgtgtcctcttgatggatctgctttttccaattcttttcaatcttctccacatggtccttccattcttttccaaagacatccatgggtttatccgtggataaagacaggtgaaggtcccctattgcatataatcccatatatcactccaattttccatctattattcaggcattccatcatttacagataacaccatttagtatcattataagatggattacggtaaaatacaacgcatgtattaccggatccacaaatgcggatccacaaatgcggattcacagatacgggtccacaatcgtgaataccgccttcgcaaaagcccctgcaaatcaagggatacatttttttcctcatctgctataataagattatatctgtcctatggaggtgagaccatgaaatgtccatattgtaatcaggaaatgaaaaagggatatattacttcagatgcgcgcttgattgcctggcgggaagaaaagcatgaatcggcaaatgttaaaaaaggagagggtatccagctggccaaaaaaatctttggaggcgcagccacaatatcagatgcgtactgctgtaaggtatgcggtaaaattatcatcgattacgccaaaacagaggcttataccgtgtaaaccattcatagtcccacggcaaagcccctgtctgatgcattgccagcctgataccagggccaatagccctgtctatcccctctcctcaaaggcccggtcagccgccagctgcgcctctatgacccggtcgcaccactggtcaaactcagggtcctccacctgtgtttcgggatgttccaccatatatctggcagcctgccggattccctcggccatggagaccgtacacacaaaatctggtaccgcccgctttatcttggaattgtcaaataccacgctgcaggatttatcgccctgaagttctccttccaggtcatactgcctcccatgccgtaccaggaaatccgttgtcacatggacggcctttaaaggcattcccatggcatctgctatggtttcataaatctggttccatgtcatgctttcgtcggttgtgatatggaaggaatgtccaatggcatgcggattgcccatcagccccacatagcctttggcaaagtccgacgcatgggtcacagtccacagggaagtgccgtccccggggatgatgaccggcttaccatccaggatgcgctttaatacctgccagtttccttttgcgccgtgaggcgtgacaggcggttttttcccgcagtgggtatggcttggcctcacaatggtgaccggaaagccatccctgcggtatgcgtccataagcgcattctcagcgtctatcttctgccgtgaatactcccagtacggattggccagcggcgtgctttccgtaatcttgtaatctgacacgggtttctgataggcagaggcgctgctgatatagatatactgtcttgccgcgcctgtaaaaagccggatatccctcagggcgtcctctgccgtatagccgacaaactgcgccaccacgtcatatgttgttcccgcaatggcctttcccaccgcctcctcgtcgtgtatatccgcaacaatggaatccatcccgtccggcaccggcctgctgcctctgtttaacagggtgatgtcccatccacgtttcaaggccagctctgtcacggatgcgctgattgtacctgtcccgccaatgaataatgctttcatgccaattcctcccttgccttattaatgtaaaatgtcctttgtccaatggtttgattgtaccacaccttatatcaatcaacaaccattcccgtaatccgattccttcaccgattccttcagaccactgaccttcatctgaatattcagtccccatatgggcccggttcctgaaccgcaggaaaccttaatatgacattatctcatatccgtcttccgtgaccagaacctggatttcccactgggcagagggtttcccgtcagccgtgtagacggtccagccatcttcctcatccgtgaagatttcatctgagcccatgttaatcatgggctctatggtaaatatcatgcctgggaccatgagcatttccgtgccctgtcttgacacatagctgacccatgggtcctcatgaaattccagccccaccccgtgtccgcctatttccttcacaaccgtatatccgttctgcttagcaaagtcatggatggcctggcccatatcccccaggaacccccatggccttacctgctgaaggccgatgtcaaggctctgcctcgtcacttccacaaggcgtttcttttcctccgaaacctggccaatacagaacatcctggaagaatccgagaaatacccattgtagatggtggacacatccacattgatgatatcgccctcctgaaggattacatccggcgaagggatgccgtggcatacctggtcattgacagaggtgcacacgcttttgggaaatccctcgtaattcaatggggccggtattccatggagccgcgttgtctgctcatagacccagcggtcaatctcttccgtgctgattccttcctttatcctctcactgatgtaatccaggacagcgatattcaccttgcagctctccctgatgccttcaatctgttccgcattcttgatgatacggtgggacggtatcaccgctcccctgcgggcatattcctccagcctgctgtcaaagctactgtggcacttcttatacttcctgccgctttggcaccagcacaaatcatttctccctaatttaaacatagctgtgacgcttcctttcctgctttccttctacacttatcaccggcacggtatggcgtacctcacttttctgatagccatttgatgtattcatgttccgtaataagaatagtctccctattttctgtttgattattaaatgcacataaaaccaaatccgtattgcgccactccataaagtctacgtcgtcgtaccggtcatagccattttccaggtgttcctgcacatccgcccagataccaggctctttcattggatgcgaaaaatccataagtaacgtcccaaacggacacgcccaataacagcctgaaacagcaatcagattcgttttcttattgtaagacacatccgtccagataaaagtctcaccttttggaaacgaaccggagggaatatagtgaaaatcctgtaatgtatctaagtccaaaacgctgtatccatataaatccgagcggaaaaccagatattcgtggccattgccatgctctatcaattcacaaaattcgcagtcatcattcagatttttccaggtgtaaagcacctttcctgtctcatcaatcagttcattctccgtagcatggagcgtatacccgcccaccttaccgctataggagaattttttcagataataatgcgggaaaatcattgtggtcttactatgacgcagataatccgcacagaaaacccgctcctgctcttggcggtatgtcctgtattcctgcgaatacgctacatttaccattcgttttttcctctctttcccacacacgtattctaccatgccttgccacccatgtctatcttattaccgcttcttcccgctctggctgaccgggcttcctgcctttaaatataagctgtatttatatacattatgaaaaaacttctcatatgaattgtttaaaatttccattttgggagaatcatactattagaagttactgattcatagttcagaaaggtaggatccaatgggacgcagttatcatttatcaaaaaaaattgcagaaaaccaggcaatggaaatcctcatggaaatcaatggtttttctgacatcaaacaggccgctttcagttcagggatggattatctggagattgaggcaaagggacatgattattccgaaatcatgagcagggccgttaaccttttcagcaaaaaggcagatggctgtgagctgtcatttgcgcgttttgtataaagggaacaggcacccggcccttaccatgtagatggcggccgacattcctgtcaggccgccgccgattatcatcacacccattaatcctgttccgtattaaatcaagcctaccagatccaggcttggtttcagggtatctgcccccggcctccacttagccgggcagacctggtcgccgtgttctgccacgaactgggatgcctggacgcggcggaacagctcgtccgcattccttcccacattgcctgcaattacttcgtaggccacaatccttccttccgggttcacgataaagcttcctctttcggccgtgccgtcagcttcaatcatcacgtcaaaatccctggcaagactgcctgtgggatctgccagcatgggatactgtatcttctgtatggtcttggatgcgtcacgccatgctttgtggacaaaatggctgtcacaggaaacactgtaaatctcgcagccaatccccttaaactcctcatacttatcagccaggtcctccaactccgttgggcacacaaaggtgaaatccgccggatagaaaaagaatacgcaccactttcctagtatatccgatttctttatctccttaaacccgttgcctgtaaatgcctgtactgcaaaatcgcttatttccttaccaattaatgacataagcctgtcctcctttgtctgttgtggtttttatttcatatatatacattaattacagctaatttgcttttattttatcagtctctcccgattttgtcaataaataatattgataatcattcttatttttatatttgatataataaattcagccgcaaggaaatcatgtccccccttacggctgaaaaaccaatcctgtcatcatgaccggattgcatccaatcggttttatgccttgatattaaacgcattgattccaggatataccgctcctgcccccagctcttcctctatccgcagcagctggttgtattttgccacacgctcgctcctgctgggagcgccggtcttaatctggcaggtattcagcgcaaccgccagatctgcaatggtcgtgtcctcagtctcgccggagcggtgggatgcaatggccgtataaccagccttatgggccatcttgattgcctccagtgtctcagatacggttcctatctgattcagctttatcaggatggaattgccgcagcccaggctgattccctttgaaagacgccgggtattggtcacaaacaggtcgtcccccaccagctgcaccctgtcccccagtctgtccgtcatcatcttccagccctcccagtcttcctcgtccaggccgtcttcaatggaatgaatgggatactggccaaccagcttttcccagtggtccaccaattctttggaagtaaagcgttttccggtcttgggcagcaggtattctccctttgtaccgctcttccactcactggaagcagcatccatggcaaggacaaaatccgttccaggcttatatcccgcccttcttatggcttccatgatatactcgattgcttcctcgtcacttcccaagtccggcgcaaatccgccctcatccccaacggatgtagccagcccttttccctttagcagaccggccagggcatggaagacttccgtgcaccagcgcagtccctccttaaagcttccggccccaaccggcatgatcatgaactcctgcacatccactgtattggcggcatgggcgccgccgttgagtatattcatcatggggactggaagcctgtttccatttacaccgccaaggaaacggtacagcggaatccccatggcgccagcggcagcccgcacgcaggcaatggacactgcaaggactgcattagcacccagctttgacttgtcctttgtgccgtccgccttaagcatggcctggtccaccgcatatatatcggctgcatccatccctttcagcgtatctgagataaccgtgttgatgttcctgaccgccttcaacactcccttgccgccaaaccgcggattgtcctggtcccttaattccagggcctcaaattccccggtggaggccccgctgggagcagcccccctgccaatggtcccatccgtcagataaacctcggcctcaaccgttggattacctctggagtcaatgatctcacgtccaattaccttttcaatttctaaatatcccatatcattcctttcccatggatatcatttacctcagggatatgcgggacagcactgcgtatctcttgagatgaatccccaacgaatccctgtgtaaacttctatcccatgtctggctggtctgttgtaatttatatcttttaaagttagttattactaactaaatatgagtatatcagattctttcctgaaaggcaagtccggacaatgacattttccattaatttttgcccttatccggcatccatctgcatttattgttgtaagaaaggaatccgtataatccgaaaagcccatacaggcctgtgtcatgatttaagaaaataaccttgaccctcacatgatatgagggtctgtatcccactttccaaaatgaaaaaagatatggatgattacatggtacatcccggcccggccgccggaacttcgtttttttgagcgggaaaacgaagttaacttttagagtatgtccaaaccattaaggcctgacatcctgaggcccgcatccagcggctgcatgtctcagccactcctcatccccctgcccgaccagccgtgcgtacttcgtccactgcggtgaccccgcttccttaagtgctgtcagtacggccagtttctgatactgttccagctcccctgaatatttcctccaacaggcccccaatcaattcattctccatcagaaattgtttccccgccaatcacaataatcccgtccggcgtttcctcatctggctcaaacacaggaaatgtcttcatctcatcaagcatatcatacaacagatccgactcataataattatccaaactccagacacgccgcagcgaatcgccatcaaaaccgcactggcacaatatgtccgggaactcagtggaaaactcttcatcaaagccgaaatcctctattataccttcacctgcacatacaaacttccggacagccccatctttacagactaccagaaaaacaacatcatcgtccaatacagataatgcaattacatttgcctgaaaatgattccccatctcttttaacaggtcttcatccagattctcagcctgccataccagttcttccgaaaatacaggaaaccatccaaggcccctgccatggtatatcttcaggtcttctatgaaatactcctgcatgaccgccttaaacccattaaactgctgctccagttcttcctgtgtctgttttctgttctggataaaataaaatgccttcgtcattcccatatgatacctcccagcttcaaagctataccagattcttaaatgccgcactaggttcccttatgacccggctgcaaagagcctcgccctcggcggccagacgttcctcatccacaccggtcagggcgccgtcccggtaaaccacatcgccgttaatcatggtcagccataccggacctgtaagccctaccctggcaatgatgttcttcgggtcgtgaagcgcgccggtcagttccagcacagcggtatcaatcatgaacaggtccgccgccttgcccggttccagggagccaaggtcagggcgtcccagtgttttggcgccgttgatggtggcaaccttaagcatttcataggccgatacgcagcctcccctctgtttgctgtggtaggtctgcatcagatatgcaatcctcagcgcatccagaaggttggaactgtcattggtggccgagccgtcgcagccaaggctgatgttgatgccggccttaagcatttccttaatgtccaggatggggaaaccgcccaggatagccggggacggacagtgggacacccctgttttggtggaagccagaacccggtattcctcaggcgtcacttcccagtcatgggcataccacacatcctctccgatgaatcccaattccgcacaccagtccatggtcctcttgccccagcgggccaccattccctcgttctccccttcgcccagatgggtgtgcatgcgcacgcccttatccctggccatggaaaccgtctccttgaaggtatccctggtacagttaatgggctggcacggcgccattacaatctgtctcatggaaaatgccccgggatcgtggtacaggtcaatcagccgttcacaatccttcaggaacccgtccgtggtctccagcatgttgtccggtatggaactgccgtccgcccttgacaaggtgttggtaccccttcccgcgtgataccggattcccagaagcccggctgcttccatctggcggtccacaggcgtcttgccggtcttattggtatagcagtactgatggtcaaaggcacaggtacagccatgcttaatcaggtcccccaacgcagtaaggctggaatagtaaatcacatctgaatcaatgatctggaaaatcctataaatcttatcaatccagtccatgaccatcaggttaggataatcaatggaggtcagattcctcacaaaggtctggaaaaagtggtggtgggtattgattaagcccggatagacaaacttgccgtccccacgtatgatttccgcgccgtctgcctctatatcctttccgattttaaggatttccggcccctcaatcaggatatcggaatcccaatatacctggtccctgctgtcacaggtcacaatcgcttttgcatttttaatcagtatctttctttccatggatcctccgccttgtcttttagcttttatcttttagcttttatcttttagtttttcttatcttaatctactgttttcttcatcatacagccatgataaaagtataccatattttcacataacttcaattatcatatggaaatccgtagtgaaaccagtgccgggcggcattcgggcgtgtttgaaaaaggcattcgggcgtgtactatggatttatggtaaagctgaaggtgcgttcaaagtccgtgtaccctgccgtcccgtttacatccttcacggattttgtaatggcataggttccttcctccaggacgccatagagggactcccagtccactgtccactccaccggattcccccgcctgggcttataggcaatgctgtgaaagtaaatcccgtctttctttaacaacggttccatatccacccatgattccccgtcatacttctgaagcctgaaatcatccccaaacacaatatccaggtctgtttcattttccagtgaaagcttcatggacgttggtgtaatatcgctttcatccgcagacatgctgacctcccccggcaggccaaaggattcgttcagcccattgatggccctcaccttaagtccctgggatgataaatcgtcgttcaatgcttccaccacccatacgcggcctgtttttccaagcatgatgccgctccagttgcagaacatcctgctgcaggtttcttcctccagctccacgaaaaaatagggattcagatcagccccaaaatcagctgccaggaattcttccggcgtatcatagattgccccgtctatggtaacaggatacgacagttccccggataatgcgtcccagtcctgtatcatcagctgctgttttaccttcttagcaaactgttccacctgggatgcagggatatcagtagccagactgtaaaagtcctcaggaaccggatcatctcccgccagcacatcgttctggtctgcaggcttgaaatcaggatccgtaccttgggccgcatggctggtcacatagtcattactgcggggcaccccgtgggcggtttccttcccctgccctggtgtctgtacttttatcccggcgctttcatccgcttccctctttgtcccgtcctcatcctgaccatcactttcatccatggccatggttttggcgctttccgttgtccgggaaacggaacgtgcttctcctttgcatccccagagcagcattgcacacatcaccacagccatgattttccttgcttccctgatgcttttctttctcataataccacctctccataccatatccgtcctgtcccaggtgcggataacccttaatatccatcgccttctgccgccttttggcattatcccttaatcatcaataaaaatcctcaatgacatacagtttatccgtttttccatcaatgagaagaaagagtacattgcgcccgtcatccctcccacgcatttttaacacagaaaatggctgtccgaaatcaggggcatatgcggatgggataccaagcggttccatgattgtcctgatttcctctgcttcactttcaggaatcctggaatccgtcagcgtaaaacccaggtctgtctcttttttatactgaaatacatgatacctctccccatccccatgaaagcttgcgccgctgtctgcccggaatacttcccttcagccatcccgctccagccactccggaacagccatctaatcaaaggatatcacatcgcagcggattttcaattaacgttaccttaaactttattaattttcagacggcaggtccgttaatccaacaggttcgtcatactcttaaggctgattgcaagggtggatgtattgtgaagcagggccgatgtggccggggcaatcactccgcccaccccgagtaagataagcgccaggttaaagccgatgacgcaccggtaattccggtcgatccggtccatcaggccccggctgattgccctgagtgtcactagctggtaaaggttatcctctgagattgtgatatctgcaatctccctggcaatctcagccccttcgctgattgcaatgccggcgtccgcggctgaaagagccggggaatcattgattccatcgccaatcatgatgactttgcgccccttttccttttctgcctccacaaatccagctttgtcctcaggcagtacctccgaataatactcatctaccccgacacgtgccgcaatggccctggccgtgcgcccgctgtcgcctgtcatcatgactatcttggatatcccctgcctgtgaagggcgctgatgacagcgtccgcttcttcccgcaacgggtcctcgatgcagattgcagcggccagcatgcctccgattgccagatacagatgggaatactccgtggacaggccctcaaacgcttccttcccgtcctccggtatcctgcatccctcatcctcaaatacgaagtggtggcttccgattaccacccgctcatcccccacataggtggcaataccgtgggccacgatataatccaccctggaatgcatttcctgatgtaccaggccgcgcttcaccgcctcattgacgactgcattggccatggaatgagggaaatgctcctccaggcaggccgcaatcctgagcagttcatccttatcctgtccattgaacacaaccacatccgcaacctggggctttgcctttgtcagggttcctgtcttatcaaacacaatggtatctgctgccgcaactgcttccatatatttgccgccctttaccgtaatatgataggcgccggcctcacgcatggccgaaaggacagataggggcatggcaagctttaaggcacaggagaaatccaccataaggatggacagggccttggccgtattgcgggtcagaagccatgtaagcacggtcccgccaaggctccagggaaccagggcatcagccagcgtggctgccttgccttccgctgtggactttaactgctcggattcctcaatcatggtcacgatgcgctcaaacctggtggaaccagctgtttttttgacgcacagcgtgatttccccctcttcaatgactgttccggcatagacatacatgcccttttcctttttcaccggaacggactcgcctgtcatggatgcctggttcaccattgcttcccctgaaaccaccaccccgtccaaagggattacgtttcccatatgtacggttaccaggtcaccctccacaattcctgaaacaggcaccaggacctctgtcccatccacgtcctgccataccttgctgatattaagggacatgcttctggccaggtcccccactgatttcttatgggtccactcttctaaaagcccgccaatccccaacaggaacatcacggaacctgccgtgtcaaagtccctccgcacaatggataccataatggccgttgcatccaggacttccacttccagtgaaccttttaacagacagcggattccttttatcagataccggaccgcatggaggaccgtatagaccgcccgcagcggcattgggaaaaaagatttggtgacggccctgacaacaagcttctgaaccagcttttctccatactcctggttcaaggccctcgcgctgttctttggcacgatttcattgagccgctcattttcataggaaaaacggcagattccttccaggatttcactcctgctgccgtcaaaaaggataaccgcatccgccgtcctctcatataccttaacgctcctgacccctggcagggaactgatatgatattgcagcagatctgcctgtctcaggttcatccccttttgatacaggtggatcctgacccttccccgtaactcatgtcttatcacaaatttcatcgctgattgctcctcatctggtaaaaaagtaccgcccagggaatttccccgggcggattacatggcggattccatggctgattacatgacggattccatggctgattacatattactccgtaaccacgtctgctggaacctgtgtttcatttaccccatcagcatccgcagccccgctcccatcctcaaaaacctcttcctgtctgcgcttttcattgatgtcctttgcttctgccaggatgtcctcagcattttcctgaatgctggtggccgtggtcatcacacagtcctttgcccttaacccggccgcaaggcagttaatgtaaaacttcttggcgtccgtacttgccagcacctttaccccggctgtcccaaacaggactccacctaaaaaaagacctattttcctgcatttaaaacaatccatcattctcttttcctcctatttatgcctttatccggtaatactgcccccgctatccccggttcgtcaattccaatacatctgattgagaaattatatcagttaacctgctcaatcctaaaaaccgtatacccgcaggcctttaccgcatctttcaaagccttgtccccatattcctgtttcatgtatacacttgcctcccctgactccagatccacccgtgcccagaccccgtccatggcgttcagtgcgttttccacacggattgcacagttcccacaggacataccatccaccttaaggatacactggtgaggataatgggacaggtcccggtcttttacctttatccgtttcacggccttttcaccggatgaaccgcagcagccggaggtcaggcgcttcaggtaactttttatgccaaacacacaaataacaattaataggatgcatatgactgctgttgacaatcttcttcctcctttggcgaagaatattggaaggtccgggcaaggacccccatctcctcaagggcgcttaccgtgcggtagaccgtggccattcccaggttggggtcgcgtttgcgggcctcatagtagatgtccttgcagtttgtccagttcccttccaggatgacatccagaagcattctcctttgctgtgttatccgctttccccttttctggaattcatcaagcacctgctctttttcccacatatggttcctccttacgcaatcccaggcgccgcaagagcgtgcccctaggccggaacgcgccttcaaacacgcttccggaaataaactcaaagacacgctcctgatactgcacttcacaggttcatatataatttacatacaatccggcgttacgctgctgatttggcttttacgccaacgttcagggaacggctctctttgtacggcctgattaacaggtaaatgaacagggctaccaggataatggctgcgaccgtccccatgccaaagctacctgtcatgaaccagctgcccagctggtagatgcaaagggatacgccgtaagccaggacagtctgatagccaatggcaaaccaggtccactttgcattgttcatctcccgcttgatggcgcccatggccgcaaagcagggcgcgcacagaaggttgaacaccaggaaggaatatgcgctgaccgctgtaaagcttcctgccagggttccccagatttcctgtccgtcttccgcaacctctgcaaatccataaaggataccgaaggtgccgaccacattttcctttgcaaccagtccagtgatggccgccacggccgcctgccagctgccccatcccagaggagcgaatatccacgcaatgccccttccgatggaagccaggatgccgtctgacaaatcttccaccatcccaaagcttccgtccacaaaaccgaagctggatgtgaaccagatgaagatggtcgacagaagaatcacggttcctgccttcttaatgaaggaccagccgcgctcccacatgcttctgagcacgttggtgaccgtgggcatatgatatgcgggaagttccatgacaaagggcgcagggtcgcctgcaaacatcttcgtcttctttaaaatgatgccggagaagataatggctgcaatccctacaaaataagcgcttggcgcaacccatgaggcgccgccgaataaggcgcctgcaaacaaagcaatgatcggcagctttgcgccgcagggaatgaaggtggtggtcatgatggtcatcttgcggtccctgtcattttcaatggtgcggcttgccatgatgccggggacgccgcagccggttccaatcagcatggggatgaaggacttgccggacaaaccgaacttgcggaaaatcctgtccatgatgaatgcaaccctggccatgtaaccgcaggcctcaaggaatgccaggaagatgaacagcaccagcatctgggggacaaagcccagcacggcgccaacgccggcaacaataccgtccaggatcaggctggacagccagtcagcacagcccacagcggtgaggaatccttctaccagcacaggtattcctggtacctccatcccgaacaggctccatccttccccgaataccccgtcgttggcccagtcagtcgcccaggttcccacggtcgtgaccgatacataatatacaatccacatgaccacggcaaagatgggaagggccagccagcggttggtgacaatatggtcaatcttatcggacgtgctcagtttctgcctgttcttcctgacatagcagccattgatgatggaggcaatgtatgtatagcgctcattggtgataatgctttcagcgtcatcatccatggcctcttcagcgcctttgatgagcctctcgacatccgggaccatggtcatctgtgcggcaatcttatcatcccgttcaaagagcttgatggcatagaaacgtttctgcgcctcggggataccgcctcccaggctggcctcaatctcatccagcacatgctccacctctgagccgaacgcatggacaggcgccgccttgccgcctgccctggccagttccactgccttggccgcagcatccatgatgccggtgcccttcagcgctgaaatctcaaccaccgggcagcccagttccctgctcagggcgtctatattgatctggtcgccgtttttcttcacgatatccatcatgttcacagccataagcacaggaatccccaattccatcagctgcgtggagagataaaggttgcgctcaaggttggtgccgtccacaatattaaggattgcgtccgggcgctccgtaatcaggtaattcctggcaaccacttcctccagggtgtaaggggacagggaataaattcccggaaggtccatgatgattacatccttgctgcccttcagcttcccttcctttttttccaccgtgacaccgggccagtttcctacaaactggttggaaccggtcaggccgttaaacagcgttgtctttccgcagttcgggttgccggccaaagcaatttttattgacattttcatatcctcctcttcctcttattgagaaaatttatcaataaattagtatcaactaactcatcgtcttaaaaaaaagcagcccctactgcacttcaatcatctctgcatctgcttttctcagcgataattcgtatcctcttacattcacttcaaccggatcgccaagcggcgccaccttgcggacaaaaacttccgtcccttttgtgattcccatgtccatgatcctgcgtttaacagctccctcgccgtgaagctttactacggataccgtgtccccgcacttaacctcttttaatgtgtgcatgttgtgatgctcctttcctcttcctgcccttttactgctatatcatgattttattggccatttccctgctgattgcaacgcgggcttcctttacgttaacaatcacattgccgttgttgacagtcacaaccgtcacatccgtgcccggcacaaatcccatattctccagatggcggcgcacttcctctttcccgcctacccgcttgatggatgtcacttcaccctctcttgccattgtcaaaggcatacgaatcactcctcttctctgttgatgtgattatgaacttacaattatgcagtcctggaaagttatggtatcctaactgcatctctaagttagcactgattaactcaaatgtcaataatttttttcaattttcttaagataaatcctaaaaaccttaatgagaaattcaggctgggcctggacgggaagacggcggcggaagacgcctgccgcattgaacacgtggtcagcgccaaaagctttaaggccatcaaggaccatatcatgcagggaaatgaactgccttagggcatacatttacaaaaacagggaaaaggggaagaccagcacaagggacggcaggatattcagcaccctggaccgcttgatatccgcaatcttaagccccacggccagcgtaatgattcctccgcatgccttaaaattagacagcatggtttctgtcacaaaaggcagtatgtaggatgccccggcaaacagcaggatacctaccaggaattgcggcacggccacaaatcccaccagatatccggctgttgtcccgaatatgactgccgtaaaaaagtccatgattgccttggcaatcaacacggaatggtccccggtcatcgctgaattcatggccccgaaaatgcctgtgccgctgaagcagaacaggatgatcatactgatcagcacatccagctgcccgtcattaaggcttaacggaagcctggattccaggccgtgaagtccgtgcatcaggtttgtttccaggttcaggagttccccgatgaccgtaccgatgataatggccaggatgacagccgacaggctttcaagacggataatcagcgtaacccccatggtgatggcggataatccgaagatgcctggcagcgactcctttagcttatccggaaaataatcctttaaaaaggcccccagaaggcctccaatcaacactgctgtacaattaatcatgataccgtatggcatactttctgctcccttcctactctttcatcagccgttccctcaggcgccggtggattttcccatataattccatgaactgccccacttctgcctccggcatcccttcaaaggtctgttcctctattctcaggaatgcctccaataccctttcctgctgttccctccccttttgtgtaaggaagatatggaaggtgcggcggttcccgttaagacgcctgcgctcaatcagtcccttggcctccattccgttgagcacggatgtgagcgtggcagcctcaatatagcaatgggccgcaatctccttctggctggccccgtcatgtccgtccagataatccagcacctttggctggcccgccgtcaggccggagtcttccaggatttccatcagcaccttgttgtaaatcgcatggtttgccatgaccatatagtggaatgtcatgctttctcctttcacaatagttagatttctaataattataattctaactatcattcctgtcaagcctgattatctttgattcaggtcagtgattccgggcagtgattttggaccctggttggaatccgcataacacaaagcaggcatccatgcctgccgctacacagtatatggatgcctgcccatgatatcaataactgggatgaagcccatcccacacaatccgtctgtaattctcccggtccgtatccccttccgtggaaaagcacaggatcctggaatcctgattcaggcccagggcttccctcagccagtccagtcccctattccccatgacctctgccaccagtcccagggttgccgcaccgctttcaccggacaccacccttgggtcatcccccatgggattgcccagaatgcgcattccctttgcagccacataatcaggtatggatacgaagtggtccgcatggtccttcaggatattccagccaatggtgcacggttcaccgcaagccagtcctgccatgatggtatccatatgtcctttcaccgtatggatctgcccatcgccggcctgtgcggtacggaaaatgcagtccgccttatcaggttccacgacagtgattacaggccgctcctcatccccatataggtctgcaaagaatcccgccatggccccggacatggcccccacgcctgcctgaaggaagatatgggtaggcttctccttcatctggccggccgcctcatatgccatggtggtatatccctgcatgatccactgcggtatttcctcatagccatcccaggcagtatcctgtaccatgatccagccataagtcctggcatgttcattagccagccggaccgcatcatcgtaattcagttccgtgatgaatgcgtctgcccccaaagcttttatattatcaagacgttcccgtgaactgcccttaggcatgtagaccacgcttttttgccccagacggtcagccgtccacgcaatccccctcccatgattcccatccgtagccgtcacaaaggtaagcccgcctaatttttccctcacaccagcatcccttatcttatcatacggaagttcactgatatctacccccagacggtctgctatatacctgccgatacaataactaccgcccaacaccttaaatgcattaagtccaaaccggtaactttcatcctttatctggatatccgcaagcccaagggaagaggccaggttcttaaggcccgccataggtgttacactgtactccgggaaacttttgtggtattcattcacccttctggcagtttccggaccaaatgccatcaccgggcacaggccattgcccttttttctcttataatgaactgccttgatacacccgtccatttccatatcctccttttatccaggcaggcgcacacgcaccagctcggcaaaaaactcagcacctgtctccaggaccttgtcattataatcaaaccgtgaattatgaagggcaatattatccgctccattttcacagtccccgcttcccaggaacacgaagcagccaggtatcctttccaggaaagtcccaaagtcctcagaagccatccatggctcacagctggcattggttcccttttcgcctgccacattgacagccgcccgcgcagccactgccgcacactgttcccagttaactgtgggtgcaaattcatgtgtgtacgtaaattcacatccggcaccgttcatctggcagattccctcacagatgccccgcatccgcttctcaatcagcgcctgcatggctggcgagaaacttcttgtatctcccagtatctccacattggacggaatcgcgttgtgcacgccgtccgtatggatttccgtgcaggatatgacagcagggtccaatgggttggcgctgcgggaaaccacggtctgaagcgccaggataatctgggccgccgtcacaagcgggtcgattcccagatgggggctggatgcatgaccaccctttccttttatacgtatggtaaaattatcctcacttgccatgattccacccacctttgtatggatggttcccgtgggcagggagggcatattgtgaagcccgtatatctcatccactggaaaacggtccagcagcccgtcctccagcatggccctggcacctttgcccggttcttctgccggctggaagataaagcgtacggtcccattaaaattcttttgttccgacaggatctttgcagcgccaagaagggtagccgtgtgcccatcatgaccgcaggcatgcattttcccgggatttagggaacaatagtccggttcccctgtttccgtcatattgattgcatccatatctgcccttaagccgattacctccgttccgttccctgcactcagggtcgccacaacgccggttcctcctatatctgtatgtacttccagccccatcccggccagcagctttgccacataatccgctgttcccgtttcttcaaacgcgctttccggatgcatgtgcagataatgcctccactctttcatctggtttttaattccttcacttaccatatcattctcctcctgattctgctgtatgtccatcttatcattagcatccatgtctgcctctggctggttcactgttcatctgacagcctggttaaatccatggccgttatatcattttccacatcccatacaggctgtgccttacccttatccttctgccccacaaaatccttcagcacatagactacatatcttgccagcccgattaacgctattacattgaaaaataccatgaacgcgcttacaaggtcaaccaggtcccatacaatggggactggcgcaaccgccccgatgatgatgaagacgcagcagataatcctgtaaaccgtaaccgcaccgggcttttcagaaacaagtgacatcaggtttacttccccataataaatatccgccagcagcgtggtaaagccaaacagcgacattgccaggaatacaatccattttccagccccgccaagggcattgtggaaagccacctgggtcagtgcaatccctgtttcccctgaatccagtgcgcccgtaatcaatatgcagaatgcagtacagctgcagataatgattgttgtgataaatgtcccaagcattgcagccagcccctggttcaccggatgttttaccacggcggacgcatgcatgctgggtgctgtcccattccctgcatcattagaaaacagtcccctggcaacgccatagcggaatgcctccttaatggtatatccggccacgcctccggcagccgcccggaaactgaaagcggatttgaaaataagtgtgatgacaccgggaagcatcttgatgttcattactacgatgatgaccgctatcaccagataagccagcgccatgaacggcaccaccagtgaggatacctctgacagacgtttaatgcctccgaatacaacaagacataccagcgccagaaggaccaggcccgcaatcagcggcttgatatccaccacccctgtcagcgcaacggaaatggagttactctgtatcatggcatagaaaaatccgattccaatcatgacactgatggaaaacagcacggacagcagtttgctgtgaagccccttttccatgtaataagcgggtccgcccctataggtcccatctgaattcttctccctgaacagctgtccaagcactgcctcactaaaactgatgggcattcccaaaagagccgtcatccacatccagaatattgcacccgggccgccggatgcaagggctgttgccacccctaccaggcttccggtcccaacctggccgcccactgccgcacacagggcgccaaatcccgatacacctccctctgatttcatgctctccctcagattaccaaacaatttggtaaaataccgtatctgtgggaatttcagcctgattgtgaagaatacacctgtgcccagcaggatccctgccaccagccatccccaaaaaatcccgtttaaagtttgaattacctgcatacctgttcccctttctattctatctccatgtagtatgatggtactatagttgaagaaaccggaggtgtcaaaagcaggccatatacggtttctaccggctattatttatcaaaatgagaatcatgatcaaaaacgcctggcctgtcccctgtatttccatatttatcatattgagaacacactttatcataatgagaatttattcaaataaaaaagaagctgcagcaatttaccagcctcttttttgtatattttgtataaatcctggccgccttttctacattcacaaaccatacttatccagtttgcggtaaagggtagccatacctatgcccagtgcacccgctgcttttttcttggcctccacgcttgtgccatagcggctgactgccttttctatcatcctcttctccatggactccagattcaggtcatcctctgcctgcatgacacctgtcctgaggttggcgggaagcaggtcaatatcaatcatgccgtccagtttcatcatattagcggcatattccatagcgttacgcaattcccatttattaccaggccacccatactgcctgatacaggcataaaatccgtcgctgattgtctgtatgtttttgttcattgacctggcatacctctgcaggtacttctgggccagaagatttatatcccctttcctttccctcagaggcgggatgtacagtggcaggatattaatcctgtaataaaatgcaggcaggaaccttccctgttccaccagttctcccaggttgacagaagaagtgcagatgatcctggtatttacccgtacccccttaagggcgccctgccgcaccacaagctggctgtccaagaactcccccagccggagctggacatcatacggcaggttctctacctcctccaaaatcagggttcccttagatgcagcctccagcttcccggccttgccttttgaagcagctgtcctggccgtaccgaacagttccctccctatttggctttggggcacggtttcacagttcacggtacataccatctctccggccctctccccctcttcgtggattgccatggcaaattttgtcttctcagtccccttttcccccagtatcagaaccggcgacggcgaactgaccatacgcagcatctcctgctttaccgcctgtatctgaggggaattaccgtcaatacgctccagcccgctcctttcccttttgcctgcaaggcccagggaatccttaagggtacgctccgcctggttaaacaggaagaaggtcatcctaccctccgtatccagttcaaataccttgccaaccagcctgtagctggattgtccggcggtaagcctgtactcatccagtccgcccacaaaattacctgtaggcgcaaggcggaccgggaccgtgaataaatccccctcccgcatcttcagtatctggcagcacatacggttggtctgtaccacaaggttatgctgatccatgacaatgaccccggcgtccagacggtccacaatggtttccagcagttccttcatagccagattctttttattctccaatgcctcctgagccttggcagatattaaatccgcaaactgctggaggaactgtttaaatatttcctggtttttcagggcatggcttctctgcttctgattaaagcaggtaaaacagattacaccgattgcctgtccctttatcatgaccggagtactcatatgaaatgtctccctgcagtgttccctgctgtggcaatccctacatatctcattcttcccaggttcattgacaatctgtgtctcaccgctctccattgctttcttcagtatatgcccttcttcagacatatctgtattgatttcctttatcaatcttcccgttcctgcaatccgcttaaaactgctgttgacaatggtaacgtcaatcttcaatatctgtgccaggatattggcataaagaatcactgtatcctgtatttcatccaaaatttccaatggtcccaccgccctgcgtgaaataagggagccacggtgcagccccctgttgacttttccatccttttattataagcaatcttccatccggttgcaacctcagccttccagctgctcccggtaaagttcccggtccttatccgtaaacacattgaatataacctgtctgagggaagaatcatgttccaggaaacgtgacacggtttccacagcaatttccgccgccctttcctgcggaaaatgaaatactccggtagatatacagcagaaagcaatggactggatatcatgctttaccgccagttcaaggcatgactcatagcaccgtgacagaagatcacagtccccgctgccgagggggcctgttatgattggtcccactgtatgaagcacatactttgccggaagattaaatccaggagtgattttcgctctgccggactgctctgcatgtccctgggcctgcatgatatcattacacgccagccgcaattggactcctgcataagtatggattatgttgtcaatacaggaatggcagggatggaagcagcccaaaagcgcgctgtttgcggcattgacaatggcatccgctttcaggcaggttatatccccctgccagagaaagatacgtttgtcctttcccacatgttccaaaaaacggcagtccgccatgccccgccttctgacctcctctgacaggtatccgtcctgcacagacaaaaaatccttcccagccggcatgggcggccgtacgttaaacagggagcgcagaaccctccatctggcctcctcacccccgggaatgtccatataccgatactggggcatctcctttaacagggtctcaatcagatattcccgtctctcctcctgtgtcactgttacccctcctttctttggaatatactttatcccctgctcccggtgcctcgcggcagtattcctgcagcccattccttacagcccattccctacatcctattcctcatgaccgctgccctctcctgtcccttccctcatggctgtccttatatccccgacgcacaccgccagatccatgttgatccccaccgcccggtatcccaggctttccggcaccgctgcctcatcaaggttcagacggatcaggctccactccctgttttcgcccatcattttctcaaatggaaaacggatgatggccggggtgttaaatccaaccccaagttccagcagcaccagcctgcgtccgactgcacggttcaggaaatccccataccgccccgctgcctgatgccaatgcccatcttccacaaaatatccgtcgcaccgcaggttcatggccatggggcctttgcagaccgggcatcttggcaccataccggaaggaatcctgcaatccttcaccgcctggttcatgcgtacgaaaagtcctgttgcatcgtaggttttgccatgacaggcttttgcgcactgaatcagcccatagtccccctgggttgcaaagatatcctcatcctcaaacccggctttccggaactgatggtccacattggtggtcaggacaaaatgttccctgccgcaaaccatctcaaacaccttgagatacaggggcagggcctgcggttcaatccggttcacataagcatgccttgaccagtagccccaccgttcctcttccgtgggaaaggggtagaaacctgccgcatacatatccctcatggcagcaggtccataccgctcaatgaattcaccgaaattctccgtaaagcggcgtcctccatagacaagcccagccgccgtggacagtccggccccggccccaatcaggaccgcatccgcgcggttcagcaggcctgccgcccgtctgacctgttcttcatagggtgtttcctgatatacgtaatccctggcaggggttccgcttaaaaactgcatccaatccataccgtttcactccttttccgtccatccctcattagagcgtgtttgaaaattgctttccgtcggctgtgcgtcccactttgtgggagatttggtcccgatgatggaggcgtagcgggctacgctgactgaatcggggccaaatataccgcgaagtgggacgtgcagacggcgggaatgaattttcaaacaggctctagcctgcccttgcaaaaaaatcccctatggtctataatcggcatatacagccccataccactgtacatctataaatataccaggaggtacataaatggaacatacaaaaaccatacccgactgcccggtggaaatgaccctgcagcttatcggcgataaatggaaagtccttatcatacgcgacctgatgaccggaaccaagcgtttcaatgagttaatgcgctccgtaagcgggattacccagaaagtccttaccagccatctcagggccatggaaaaagacggcctggttacccggaccgtttaccctgaggtcccgcccaaggttgagtatacgcttaccgggaccggatacagtctgaaacccattctggattccatgtatacgtggggtaatgaatacaaagccagtctgtaatgtaataaaaaacggattaattttcaaacacgccctaaaacacatacggaggattgccggaaaaatcagcaatcacgccatggggatgttccagataaaacacggtaaagaccggattctccgcagtgccgtactgcccttttacgatggggttgcccatacaggcctccttaacttccatattgtcttcaaatacagcctttccatgcaggcggatccaggcaaagccggcgtcagcaacgctcacctcaatctccgggttctcctgcatatccttatacacatccttctggttgttggtgcagaaccagagcttcccatccttttcaaaacagaacatgaacggacggcattttgccttcccatcccttccaaccgttgccagatactgtacgggatttgcctgtaaaaattcaactactttctgcatactgcttctctcctttatcatccatcattttgaggaatggccatttcctatggtcttattataaagggggccgttaattcctgtaagtacgcactttgaagtgggataggttcccaaaaggtacttagtatcaaaaagatactcaacatccaatggatatcatctgaccaatccaggaggaccggccatttgaagatgccccttcaaatggccggtcctcctgctcacacatccttgggaaccaaaggcttccttccctgttccttcaccaggcggtcaaattcctccagcggcatgggtttaaagaatgtatacccctgcaccacatcacatccgcagttcttcaggaattccacactgtccgtatcttccacgccctcggcaatggtctttatcttcagctcctttgccatatggatgaaattggagattacaatccgctcccttcccatgtccctgctcttgtgaaagaacatgatatccagcttcagcacatcgatgggaagattcttcagcaggttaagggaactgtagccagaaccaaaatcatccagggaacaggtaaagccattggactggagctgccgcacaatgtcggaaaacatatccgtatcgtttaacagcacgccctctgtaaattccagttccagatagccgtcaggaatcccaaagcaacgctttgtctctgaataatactgaatgaagtccttccggagaagacccaccttggaaacattgaccgcaatgcttaacgggcgtccacctccgtccagataattccggtaccatctgcagacctgcccgaacatataccggtccagcatcacgatccggtcgcttttctcaaacagggaaatgaaccggtccggaggtacaagtcccctggaggggctgagccagcgcaccagggcttcggcgcctgacaggcagttattgttctgtatattgaccttgggctgcatgtaaaccttgaattcaccggcctcaattgccttctcagcttctgactccaggatggaatcctctatctggcgcatccttagcccgctgtcatacagggcaaagttactccctggtttttccttggcaatcttgtgggccatgttggcataattcatcagcacatccatggagagcttctcatccccgggactgagccggtaaatccccacagacagctcaatgaacgcctggccttcaacgcctgcattttttatatggtccagtacctcctgaaactttatgttcaggccttcctgattcccgcactttgcgattcccgcaaaattatcggcagatatacggcatacaatacactccttatcttccagttcctgaagatattccgatataagcctgaggatcttatccccttcctcgtatccaagtatgtcattgatgaacttaaacttttttaaatccccataccacagcacgtaggaggacaggtcattcttttccatgaacggcttcacatccagtttaaagccgtcaaaattgcgcaggcctgtaagggaatcccggtatgccaggttcataagcattttctgggtcctggcggccatacttctctgccttgaaaggaacagggcaaacagacagcaggacaccacgatgattgtcatgatcccggcagctgtctgcgtatacctggcacgcagcacacggtcaggcaccatgctgtgcaggtaccagcggtccttcaggatcgggatgatcacagatacctgcttcctgccggtcttgtctgtcatgtcaaaggatgcgattcctcctgtcccaaccgcttccttaaccagctcccggttctcaggcaggatatccccgggataagcattgatggagcgcagcacataactgccgtccccattgactatattggaaaatccctggccgctgagcacaggggcatccaggatccggcgcagcacatccgcggaatggaccgcgcataacacgcccatggtccctccttccggattgcggatattgactccataataattcacatagtggtccttcacacgctcatccgggaatatatccgataccgtgctggttccatggagcgccttctggaaaaactccatgtcatacaggctgagttcatagatactgccatctaaatccaccagccaggcgctgccgtccggccaggcaaatcccatctggataaaagcattgtcattattgatttcctgcaggatcggcagcagctgctcccgctccattttcccaatctcgcccaggactaccgcaaggccctccaatgtctggaggtctccctgtatctgctttacaatggtggtttttttctgttccgccgcattatacagcgcctcgattgtctccacctggttctttctgatcatctgcaccagaaacagcaggctgctggcaataaaacatgcgcacagtaacagtggaagtactgtatcccatatcctttgcctttttctgtccgaccctctcatctcacataccccggccttttctcacagtaatatactcatataccgattattcaggtaatattataataatatatccgggaacaaatggcaatcagaaaaacaggcagcaaaaccgctgcctgtcaccaaactttttgtccatggccaagccatggatgaatgaccatataccttactgttccgcccgttttacctgaagcggcatccttacgcccatggggttaaggagcaccccagtggcctccgccacaaggatctgtggaatcttgtcagctgtcacgacaatggggcggagctggttctctttattgaacttctggaattccatgatatcggtgaatatggcctggtaaacttccttatcattcagcttcaccacgggaatcccattgccctctttctgtacggcaacaatgaagcttcctttgctgaaataattggaaatctcatcctgccattcttttatctgtggattctcctcctgtcccggctgcttcctggtttcctgcatatagtaaagggcggtcaggtgcagggcaggattctccacccacagcttgccctccgggtcctgctccggtttattgcgtctcacaaaatcagccagctggatcagggtctgtgtgtccccttcgcttaccagaagtgcgttgatgcccatggtgtacaggctggtatagaacagcagcatctgcctctgctccagttttacgatacccacaggtatcccggcctcccgcagctgctttaccttctcttccgcatcttccgcgctgaaaaacatcatgatctcatcatcaaaggtttccgggtcgcaaaccacatatggttccttggtgcaccctgataccaatgcccagagtgactctgcggttttaaggcgctgtatgatttcctgattccctgtgttttcattgttgttcattgggttctctccttttctacctttttaagtacatccgtgcagggccttgtaccatctgtccttgtgcgcggaatacctaaaccagactatcgtttcctattatatcattcctttcactcatatgccatttattttataaatcttttctattacgtttccattacctctatttttgtcccattttcctatatgatacaactttgatgcatctttgatgcttttttgatgcctgggtattgtaaattaaacaggaagtcaattccaataaagaacaaatgaggtgcgcaatatgaaaaataagaaactatggctgtgtatgctttccgcaatcctgctcctgtccctgtgcccggctgcctacggcgaagaatccggcaatgacaccggggacaggacccttgccccttatttcatggttgaaggggcggatccgtcgaccgacagctttccgttaaaggatacaaaggtatcaaccgtcataaacggtgtcatagctgaaacctatgttacccagacctatggaaatgaaggcagtgtccctgttaatgcgggctatgtctttcctgcatccaccagggtttccgtccatggcatgaaaatgcaggtcggggacaaggttgtcaccgccaaaatcaaggaaaaggaagaggcaaagcaggaattcgatgcggctaaaagtgaaggaaaaagcgcatccctccttgaacagcagcgccccaatgtatttaccatgaatgttgccaacatcatgcccggggatacggtaaacatagaactgcactatacggaaatgattgccctgtccgaaggttcctatgagtttgtattcccggccgttgtgggtcccagatactccagcccttcaccggacatggaggaagacggggatcaatgggtgtccagtccatatcaggaagggggcgctgttcccaaagggacctatgacattgcagtcagcctttccacaggcgtcccgattaccgggcttgtttccagttcccataaaatcaatatagaacagtccgctgactcctctgcccatatcacgctgaaggacccggcggattacgggggaaaccgcgatttcatactgcgctatcagctggccggacagacggtaagcagcggccttatgctgaataccggggacagggagaatttcttcctgctcatggtccagcccccggaacgtgtccctgcagaagccatcccaccacgtgaatatatttttgtcctggatgtgtcaggttccatgttcggatatcccctggatactgccaaggagctaatcaggaacatggtttccaatctgcgggaaaccgacacctttaacctgatactgttttccaatgacgccatccgtatgtcggccagatcacttcctgccacggatgagaatgtggagcgggccattaacctgattaaccgccagaaaggcggcggcgggaccgagctggccccggccttggaaaaggcggtgggaatccccatggattccggcgcaggcagcgtctcacgcagcgtcgtggtcatcacggacggctacatgtccgacgaacaggccatatttgacattgtagcaggaaaccttgacaccaccagtttcttttcctttggtatcggcacctccgtgaaccgttacctgattgagggcattgccaggacgggcggcggcgaatcctttgttgtcacggattcatccgaatccgcggatacggccagactttttgacacctatatacagtctcctgtcttaacggatgtccaggtggactatgacggatttgatgcctatgacgtcgaacccacggccatccccaccctttttgcccaaaagcccattgtgctgttcggcaaatggaggggtaatcccgccggcgccatccacatcacggggaagtccgggaccggggattacagccagacaatccaggtttcagaagcatcctcctcagcagaaaacagcgccatcccttacctgtgggcacgcacccgcgtggagaacctgatggattacggcttcagcggcggggatgaggaggctgtcaggaaagaagtgaccgccctgggccttgactacagcatgatgacatcctatacctcctttgtagccgtgatagatgaagtgcgcaataccacaggtgaaagcagggacgtggaccagccgcttccccttcccctgcaggtatctgacctggcggtgggaggaggttacaccattggctcggaacccagtgtcctgattcttatggcagccgcggcttttatattgattttgaataccgttgccggcagccatcataccggaggtaagaatgatgactgagacatgggcgccaggcccctgtaaacaaaagtccatgctaagacggaactggccattctatctcaccgggacagccaccataatcatcatcaaaggcttttacacacatggggccgccagccgccttacatggatcctggcccccacggcccggtgggtcaggaccttaagcgggattccctttgaatatgaccccattgcaggatatgtgaactatcccctccgctttatcattgcgccatcctgttccggtgtccagttcatgatgattgccattgccatgcttatcttttcttatgtgcaccgcatggacaccataaggaaaaaagccatctggaccgttttcagtttcgtgatatcctatctgtccaccgtccttgtcaacgggttcaggattgtgctgtccatatatcttccggcctcacttccgctctggctgcacaatccccggctttatgacggatggctgacccatggacggctgcacaccatcatcggcgtagctgtgtattttacctccctgtccatcctgtatcacgtggccggacatatttcgggcaggccgtccttccggtggctcccgcccgtattctggtatgtttccattgtgctgggcatccctttcctcaaccgtgcatacaaagataacggacaccgcttcctggaatacgcagcccttctgacagccgtatgcgcggtcatcctgttccttttctttgtggcaggcaggatgaaaagatgttttatgaaaaaggatggaaatgtttccagggacaaaatttagctgatttataaaattcccctgccatccggcgtccagccggtcagcaggggaatcctcatcttatccgtcttatctcatcacagttctacatgtgtcacagccctcacagccctacatgtgtcactgccctacacatcatcacagccctacctgtatcactgccctacacatcatcatcgttctacctgtatcacaactccacgtggctggtattctgaaacaccggatacaccgccgtagaatgcaccagccccagccttacgctcatctcagcatatgcaagcgcgataaacgcggggtcgaagaccttaactggaagttccttttccagcatcgccccatagcttgccatgcccaggcagcccaggatgacgccgtccgcctgttcctgcctcaccgccctcccgcagacctgtttcagataccgcgcagttgccccagggtcggtcctcagttcaccgatgggaatgtcaagcgcctgcacggaggtcatcttttccctggcaatcccattgcgcatcagcctccggtatgtccttggtatattagcgccctccgtcgtgactaccacgaaacggttgcacagcaggttggcagcgcaaagactggtctccccgggtccgatgaccgggatcctgacattttcccgcaccgcatcaatccccacatcgctgaagcagtatatgacaatggcgtcatagccctccttctcggcttttatgccctcctttacaagttccggggcggcaaatgcctcgtccgtgttgcagtccagctcatccggccctttctttatgcagtccacggatatcaccacgccctctgacacggcggctgacagcatcttttccctctggtccatggtttcccggtccatggccttgtctgtcatgattactttaatcttcattcctacctccacacatctgtctcgatgcctatctcagatgacacaaaacgcctgcctccgctgcatttataatgcttatatgcattgaggatgatattcctggccatgagcagggtcgggatattgatgaacaccagcactacgttaatcaaatccgatacataccacaggttatccagctgaagccctgccagcacggtaattgttcccagaggcacaaagaaaaatgcgcccagcacgcggacaaaaccgataaaacctttgctggtggaaatcttgttggctgcaatctccgcataggtcaggtcgcacaacagggttgtgaatgcaaacagtccgaatgcaacggccacgaagatcagcaccgcggtgtccatggcagtgcctggaaccagttctttgacagaggtcaggaaggtgcctatcttatccaacttcagggtatcccagtcaagggcgggattctcccagatggttcccgccgtgatgacaaaaccggtcagggaacagattacgatggtatccacaaatacgccgatggcctggacaaagccctgttcacagggatggtttgcatcggcaatggagctggcctgggtggcagtacccatacctgcctcattggagagaagtcccctcttgagtccctgggccatggccacgccaaaagcgcccccgaagaccgccgatggcttgaacgcccctgcaaacacagcaaccacaaaggccggaaccttattcaggttcagtatgataagcagcgcaatcactgcaatatatagcgccgccatcacaggaacagccttgtcagagaaccggaccacgcttttaatcccgccaaaggtaatgaccgcgataatcaccacaatggcaatggcaatgatataataaaggggttctgaaacctgggtcacacgcccggtcacctcattggcaatggagctggcagccgtaaacacatggaacgtatgtaccgggatactgagcatgttgtagagcaggtacaggatacacatccccccgccgacccatgccttgttcttccatatcttctggatataaaaggtaaatccgcccacatattcatcgccctttttctccttgtatatctgcgccagggtggcctcgccaaaggaggttgccatgcctgcgaaagcagatatccacatccagaagattgcgccggggccgccgattgtgacggcgcccgtaacgcccacgatgttgcctgcccctaccctgccggccatactgatcaggaaggctgcaagctgggtggtgcccaccttggcctttgtctttgcagtaagcagcttaaggccggtcttaaattccttcagctggacaaaattgaatttaaaggtaaagtagaaactgcctcccagcagcagtaagattgccagggagaactgtcccagaaccgggataccggaataccacgcataattggttgggaaatcccataggaaatccgcaacaggcacaacgcctgcaaacatcctgtccaccatctcaaaaattcccgccatgaaccatttcctccatctcatcttgtattgttaatgttttccaccgcatccgctgtaataacggtacatttcctcaccggttgcccaccagacaccgcccagatcattgatatgatcaatcagttcctccagcatcccaatcctgcctggcgctccgatggcagctgggtcaagctgcagcacatagcatagcccgtattcatggcagccgctaaactcatccttccagttgctcagcacgcctgtatagttggcaatccttccctgccctgccggaaatgcaggatgatagttaaatgcaaaataaggcaggtcataattcacccagtgtatgggaatctccaggatggaggccccatcccccaaatcctttacatacggcctgtcatcatcacagagattgctggaatataccatgccatgctttcgcgcaatcctcagcgtatccagggtcaattcgccttccgggcttctgaatcccctgggccttatgccgcagagccgtccgatggcctccgcgcccttccggatggcttcctcctgttcctcaacggacagcagggccatattctcatgccggtagcccagggcgccgatttcatggccccgtccatggacttccaggactttatccgggtattgctccgccacccacccgggggtgaagcatgttgcctttatccctttatcatccaggatatcgaggatgcggtccaggccccggttcatcccatactgtcccagggacagggtctttggcatattgacacatgtctggtccagctggagccagaaaagctctgcattcaaattaatggtaatcatggccgcgcattttttcccgccgggccactggggtctttctaatctcatctatcccacctcctgaatcttactgtaatcagaaccggaatgttctctgtaccagtcggcaatctgggacccggttgcaatccacacatcctttttggacgtaatgtgctgcagcagatggtccaggatccgtatccttcccggggaaccgattacctggggatggctcatgaaggaaatgcacagtccgtatctgtaatgcccctcaaactcgcgcatgaagttatcctccacattccggtaacaggaaatccggtcctgtcccgccggctctgccggatacatgtggtaggccatggcaacatagtcgtccacctcccacttggtgggaatctcgataaaatccgtctccctgccgtcaataacagtcctatagggccggtcatcccctctcatggaactggaataacggattcccctttcatacagcagcttcggcgtttccacggcccagtccccggagggcgtcctgaaaccttccacatcgtgtcctataagctcccttaatatcctctggggcttttcaatgatttcaatctgctcctcagccgtctttccggcaaacctttcatgggcatatccatggagtcctatctcatgtcctgcggcggcaatccgttttaccacctccggatagcgctccgccgtaaggccgggaatgaaaaaggttgcctttaccccatactgatccagcttatccaggatcctgtccgcgcagcgcttgggaccgtactgtcccacggacagggacttgatgtactgttccccgttcggaagccccctgtttccattttcccaggttgtatcaccgtccaggtcaaaggaaaacataaccgcgcattttttgccctccggccattgaatttcatccatgctccatcgctccttttcatgattattgtatatttattaacaatagtatggctgtgtatttaacttattgttgtttatatatagcaagaaccatgccaaggagaaaataacgtatttttatgcattttcatttatattgatatgagaaatagggtttataggataatatttatcctgcaaaccctatttattccatggcctatcctgttggttttaataatctatcccataacccattctgctggttttattaacttatcccataacccattcttctgttcttaataacttcccccatgaccatcacgcccctcaatggcctggagaagggacagcccgtcctccgtgattacactgcctccccggcccctgacagacctgacgaacccgtgggcggacagcttagacagcgccttcctcacctcggcttccgtgtagaaccctccgttgccgttcaccttctccagcagcttctgccgcccgtaacgttccttccgctccagggattcacgcagctgcacaaggactgccttatataaccccaaatccttccactcatttaatatgaaccgttccaggattcccggctccttccccgccgcctccggcatgcgggtcttctgtcccctgcccgcaaaaccggggacagccctttccctcccggtccgcaggggcggcaggtcctctgccccaatcacctgcttttcctttgtcagaaggaactccaccacattgcgcagctcccttacattgcccctccacggataatgggtgaggattgcctctgcctccggcgtcagctccatgtccgaacggttcctgcctgcaaagaaatagaatatgggaagtatgtcctgggtccgctcccttaaggggggcacgttaaggggcagtacatttaaacggtagaacagatcctcccggaagccgccattttccaccatggtaaaaaggtccttgttggtggctgcaatcacccgcacatccacgtcaatgcttttatccgaaccgatccggtccaccttccgctcttccagcacgcgcagcagcttggactggagggacatgggcatttcccctatctcatcaaggaaaatggtccctctgtgtgccagttcaaagtaccccatcttgccgcccttcttggcgccggtaaaggacccttcctcatagccgaacatctcgctctctaaaaggctgtccggtatggccgcgcagttgacggccacgaagttataatttttcctggcggactcgttgtgtatgccctgggcgaacatttccttgcctgtcccgctttcccccgtgatcatcacggccgcgtcggagcgcgccatctgcctgccgttgttcacggcttcccggatggccctgctggtcccgatgatatcctcaaaggtataccttgccctgtggctggtcccgtacagcttggagcgcatgtcatgctgcctggtctccgcttcctcaaagtcctttagtgttatgatatgtcctgcaaccttatccccggaacggatttccactgcggatgcaatcaggttgctctcccctgtcttaatcagcttttcccaggcgctcttcacatccagctcgggcagcagctcctcaatgttaaaccccagaagcaccctggagcggtgggacatcagctgcctggccttctcattgcacagatacacgcggcccaccacgtccgttatgatgattccctcattcatcaggttcatgagggtattcagcttatccgacatattttccttgtcattgagcagtttatccatgctggagtcaatgtaataatactcccttctggcagcagccgcttccttggaggaaaactcatcataaacccccagtttctcagcaatgatatacaggctgttcatgtcaaccgagctttcgcccacatcgatgacctggctgattccctggggcaccaggtgcccctcattgggggtgatggccagccggatggacctgtcgtattcccccgtcccatagtacgggaacagttccacatcccgaaagcccgaggcatacatgctggttatggtgtgcatgcaggtcctgtggtcaaagttgaccagcagcgccttggttccctttggtatcttcttaagcttttccatttgttttttggtcagggccagcgagaggaccacgatttcggactggtcgctgattttctggcggacctgctggaatatgttaaatgccgacaccagcacataatcctcctctatccgtttaagggtctccacttccgcaatggaataggccttaaagcttgcgtatctgcccagatatttgctgatgttgtccatcaaaaaccttgcatattgcttttccgttgccactaccgctatctctttcatccaccgtcacctcgcccgtaccgcatatggtcaattatacctgaggcggatatctttttcaactcccctgcttcttgcacataccgtgaaagctgtatataatggtatgagacaatccgtaaaatggaggcccatatggcaaaaatcgtaccaatgcaaagcctgtactgctccatgcaggacgagaataaaatatgcagttttgacatcgaggtcctgacaggaccaaccacgcccctgatccatcccatgtcccgtttctggctggtcaacagcgggaaagggacgcttatgctcaacaaccgtccctatgatctgaaaccaggcgccgtggtctgtgtccttccctggcagatcagtgacatcgtggaggtggaattgcccatacagttttttgtgatggcgtattactttgacaatatcaatgaaatcatcaagaccttttataatccgggcaatgaaccgctctccatcatacagaccctttccgccaacccggtcctgtatcttgaaggcgaggcccttgcatccatgcagaagctgttccttcagattaagggagaaatcggcatggaatccaccatggaaatcggcacggaacccgccgtggagtccggaatggaaaccgctgtggagtccggaatggaatccgtcgtgaaatccgacatgaaatctgccccaaagtccgtggccgacatgccgcaggattcccccatccacccatccgctgcatcctgtcccccttcccaggaactcagcaacctctatatcaccaacaagctcattgaaatcatcattcatttcctgcgcgcaaaaaaggcggcattcctgccgccttccgcccggattattgaacccagtgagatattccagtatctgtacagccacctgaacgagaaaatcacactgtccatgctgtcccagatattttatatgagcgagtcctccatcagcgcctatatcacaaggaccaccggactgtccttctttgacctgttaaatgaaatgcggattggaaaaaccatcaatttcctgctgtacaccgactttaccctggaagagctggctgaaatcctgggctttgtggacagcgcccatatcagcaaggtcttttcagccagggtaggaatgaaggccaatgaattccgcgccacctaccagaaggtgggcagcctgtgccggattaaggacaggaaggacttctacaccattgtttcctatatctaccgccactacagcgagccattaaatccgcgcatggtgggggaacgcttccacctgtcgcccagagagctgaaccgtatcctcctgtaccaggtggagatgaatttttccgattacctcaacttcatacgggtcaaccgggcgtccgagctgctgcttttgaccaccaggagcatccttgacattgcccttgataccggataccacaatgagaagacgctgacccgcaatttccttaagttccgctccatgacccccggcaaattccgccaggctgtggaactgcaggaattttagtccccggaccgcttttcatccccaggccagttttcatccccggaccattaatcgattaccttcagcccctttgccacaatggtgatgaagtcctggacattggtaaccacggtggtggcgcacaggcttcccctgtccaatagcttgtttacaacaaactcatccgcatccacggtgtacaggtagaccgggcgtatggtgccatccggcatcacccggaaggacggcgtcatattgccagtggcaatggtgtgaagcatggttgccaggcagatgacgcaggtagacttcttcacaaggccgcgcatggcgccctgtccctcatacgcgctggcaatcacctccggcatgggtccgtcgtcccgtatggatccggtcagcaccatggggacatggttcttcacgcagctgtatatgatgccgttgtcaatgtcataatcctttatgaactggggaatggagccgcttctcctgaccttgttgattacatccagatggttgtaatgtccattgggctgggatacctgggtatagatgtcctgccccagggcggtgtgcagcagcgctccctccaggtcatgggttgccagggcattgcctgccatcagcccatgggcgtaaccgttgtcaatcagcgcctgcatggctgcccttgcatccgcgtcaaaggaaaatgcaggccccatgacccatacgatattgccgtattccctttcatgccttaacagttcaaacaggttgtcataatcccgcgcataggaggtctcccggctcctgccctggcggaacacgaactggtcctccagctgccccccttcttcctcaaagccgtggcagtgcatgtagatcccttcctcacatttttccgtccgtccgaggattaccttgtcgcccttcttaatattcctgttctcaaccacttcaaggtgaccgtcgtcacagagcaccacgctggagtccatgcggctctcctcggccagcacccatttcccattgattttaaaatattccggatacatggaggtgctgtgatagttatcaggcgcaaccccgtccatgtccgctgcctcgtatttcacatccggggcattcacgaatttctcctgggtaaaatcaggatgatgatattctggtaattgaaatgacatatggtttttcctctctttttcttaaattaatcaaacacgccctgggccgggagcggatttccaaacacgccctaacaaagggtggcatagataacggccttgattgtatgcatgcggttctccgcctggtcgaacacaaccgactgccttgactcaaacacttcatccgtcacttccatctccgtgatgccgaacttttcagcgatttccgctccaatggtggtcctggtgtcatggaaggagggcaggcagtgcatgaaaatagccgtgtgccttgccttcttcatcacctcttcgttgacctggtacctgcgcagcagttcaatcctggttccccagacagaatccggctcccccatggacacccagatatccgtgtacactgcgtccgcatccttcacaccctggtccacatcctctgtcagccggatggtgcattcattttcctctgcaatccgccttgcctcgtccaccagttcctgagccgggaacagttcctttggggcgcaggccgtaaagtggatgcccatcttggcgcaggccaccatcagggaattgcccatgttattccttgcatctcccatgtatgtaaagcgcagccctttgaggcagccgaacttctcctccagcgtcagaaggtctgccagcatctgggtgggatggaactggtccgtaagcccgttccacacgggcacgcccgcatactccgcaagttcctccacaaccgactggtcatagcccctgtactcaatgccgtcatacatccttcccaggaccctggccgtatctgcaatgctctcctttttgcccatctggctgctgcccgggtccaggtaagtcacacccatgcccaggtcccgtcccgcaacctcaaaggcgcagcgggtgcgggtggacgtcttttcaaacagaagcacgatgttcctgttgtccaggtatttgtggggaacgccgttcctcttcatgttcttgaactgtttggacaaatccagcagatagcggatttcctccggcgtgtagtccaataacttcaggtaattccttcctctgatattcactgccatcttccttactcctttgctatgttatttgattgtccggtcgcgctccaggtcgggaatggatgttcacccgcgttccaggggcatgctcatgcacctggggcctccccttcccctggacagctccgaactgggcatttcaaggacctcgatgcctttatccctgagcatctcattggttatataattccggtcatataccaccaccttgcccggctcaatgcacagtgtattggaaccgtcattccactgttcccgctccgaggcaacccggtcctttccgccgcagcgtatcatggtcaccttatccgtccccaggtaatctgccaggacagccggaagcggacggtcaagttcccttaccgcaagcctgcccttttggtccccgcgccggatttcatagatgcgcaggttccccaggattccgggatggatggtgaacttgtcgtagtccacctgggtgcacaccgtatccagatgcatgaacgcacggatactggggatatccagggccaggatggtctccacctcacaggagctgtcctcaaacaggttctgggccagaagttcaattgcctccggcgtggtcctctgggagattcccacggccaggaccttgctgcccaggttcaggatatcgcctccctcaatggagaaaggatactccctcttatagtaaaacggcgtctgccccctgtagtccggatggtgctccagtatatactgcccgtagatggtttcccttctcctggtccttgaatacatgcagttcaggctgactcccgtgccgatgcacgcaaacgggtcccttgtaaagtacaggttggggatgggatccatgatgaaacggctgtctgatttgaccaaatccactaatggactgtgggtttcagacttaatctcatgcatgctgacgccggacattgtctttagcaccagctccttttcatccggaatatccatcaggaagccaaacagctggttcctgaacttctgcgcggtgttcccggcctcactgatgaactgccggatgaagttctccctgatatccccggactgtcttaacacgtccgccatcatgtcctccatatagaccacctggcttccgttttcctttaaaatgcgggcaaaaatatcgtgttccccctgggctgtcttaaggtatgggatatcgtcaaacaacagccgttccagttcccccggaaccaggtgttccagttccttccccggcctgtggagcatgacctttttcaactttcctatctcgcttttcacacagattggcatgcaattatctcctttgcgctcttgttccgctctcttatggatattctattatatttttattgggacgataggacatccagggagcctgcactggtattttaacctgttttggcatggaatatgtccgggacatatgcgccggaaccggcgcaatacaaagatgtaagaatggaaaccgcgcccttttccagttccatggagcggtttaaatacaaaaatattttccttatttgtctgaaatatgctaaaatacctccatggcataaagcaatggaggtatctgtcatgacactgcagcaactgcggtatattgtaacaattgtaaactgcggctcgatttccgaggcggcaaagcagctcttcatcacccagcccagcctttccaattcggtgaaggaactggaaaaggagatggggatttccatctttaaccgcagccccaaagggattgccctgtcctctgaaggcacggagttcctatcctatgcaaggcaggtactggaacaggcggaactgctggaacagcattatacgggaaggaaacccttaaaacggatctgctccatatccacccagcattatgcatttgcggtcaatgcattcgccaacctggtatccaggcagaatacggattcctatgaatttaccctgagggaaacccgcacctacgaaatcatagatgatgtgaaaaactaccggagcgagctgggcatcctgtatgtcaatgaattcaaccgcaaggtgctggagaagctgtttaaggaaaatggacttgtcttccatcccctgctccaggccgaccctcatatattcatcaatgtatcccatcccctggccggccgcaaaagcgtttccatccaggagctggaaccttatccattcctggcctttgaacagggggaacagaattccttttacttttctgaggaaatcctgagtaccattcccaggaaaaaggtaatctatgtaagcgaccgggccaccctttttaaccttctgattggattaaacggctataccatatgcagcggcatactcaacagcaatttaaacggtgattccattatcgccgtccccctggagacagaggaatccatgctcatcggatggattgccaatcccaggctgcatctcagcgaatttgctaaaaagtacctggaggagctggaacggctgatccggtgataccaatcccctgctttccctgtcaggaagccatcagccggaatacggactcatggattttattggcaatatagggattgttcatggtatacagatggattccgtccaccccatgggccgccaggtccacaatctggtcaaccgcgtaggcgattcccgcatccctcatggccaccgggttatccccgtaccgctccatcatggatgtgaactttttaggcagccggacgccgcaaagggaaaccatgcgctcaatctgctttttattcacaaccggcatgattcccgcctccaccggaacccggatgcccgccaggtcaagccgttccctgaaacggtaaaaatactcattgtcaaaaaagagctgggtaatcagctggctgacccctgcgtccaccttgtgcttcagattgtggatatcccgcaccaggcccccggattcctgatggccttccgggtaacaggcgccaatgatattaaaatcgccgtgctccctgatgaatcccaccagatccgcggcatacttaaaatcgcccgcaggctccctgtccgggatgcggtcgcctctcagcgccaggatattctcaatctgatgggcctttaactgtaaaagtatctctgcggcatcttcctttgtcagatgcaggcagggtatatgggccacgctttcaatcccgtacctgtgcttgatggaggatgcaatctccagggtggcgcggctgttctcactgcctcccgccccgtaggtcacactgatgaaatccggcgtcatgcccttaagttcatccagtgtcttatatatggtatccacgggcgctgtccgtttgggcggaaatacctccaaggacagcactgttttctgtttaaaaaattccgatgtcttcatacattttcccctctttcctgattgcagtcatcatagcacaaacagaaaagaggcggataattcctattttttatggctttctatagatttaaactatatccctgtcataagccttgatatacacaaagttttcattgttccggtccatggtatattccggattcaggacagcgtcaatgaattctttcccgcccggctcaaccgcagccagcttcatgcccagttcccgctccacatcctccaccgtcaggtcgtccaggaatacctgttcccccatgcgcagcatattggaaggaatcagcagcacgctgcccaggtcctcccccttatcctggcgctccttcagctgcccgatcaggtcctgtcccgttatcagacccgatacggtgatggtctccccgaagaaatcattcctgatataatacacatggatggtcaggtgggggaacgccttcatcagcttgtccgcaaacccgcggatggtggggtatgccagcttcccggttgcaattgtaagcgtacgccttacctgccctgccggcgcttcatggcccgcgccgtgaaccacctcatccagggccttctcaaattcattgatgagcatgcgcatcatacccacgccgttctccagctggatataaccgtcatagcgctcctcctccgggaactcccggcctgccgtgatgtaccactcgtcgcttgcatggatgaaatgcaggccgaacctgtcatagtattcctgctggcggctttctaccatgtcaatcacggcccctgcctcttcctttgtatacagtccgatggggaacaggttgtcccggaacctggtgattccggccgggacaaccgatacgctccttaaaaacggcaggtaccgggccaggtcatccatggtccgttccagttccgccccgtcgttcacattcttacagcacacaacctgtccgttcatctccacatgcccgtcatagagcatctgcagatacttcagcttctcccccgcaaaacggttgttaagcatcttacaccgcagttccgggttcgtggtctgcacggaaatattgatgggcgccagctgcatccggatgatccgctcaatatccctctccttcatattggtcagggtgatataattcccctgcaggaaagaaaggcgggaatcgtcatccttaaaatacagggtatccctcatccccggcggcatctggtcgatgaagcagaagatacacttgttgctgcaggagcggtagtcactcatgagtccgttttcaaactcaatgcccaaatcgtcgtcgtactccttatcaatctccagcagccattcctcgccgtcctgtttccttaccagcacctcaatatattcatcttttatcatgtacctgtaatcaaagacgtcctccacatcctggtcattgattgcaagcagcacatcccctggttcaatccccatttcttctgcaatggaaccgggaaacacttcctttatcacatgttcattcttttttattttcaactgtaatccctcgacctatcatttattcaattcacacagaccagaatagcagtaatggaagcatttttcaagggctaacccttttcttttctgcattcccttttattcacagttatctacgcaacgcagtactagtcacgccttcgcctcacggtaacaggaccacacgcagcagcctgtaaacaatgccacgaacagggccgatacgcccatggacaaaaagcttacgccgcccccaaaggagatttcccggatcaggcgggtggtatgggtcaggggcatgatgtccacaacccactttaatgcctgtggtatgccgtccagggaaaagaaggtaccgcacaaaaaggacatgggggtaatcacgatattggtaaagttattcatatcgtaatggctttcaatcatcatggccgcaaagaagcccagggctgcaaatatcagtgaattaaggattaccgcggtcagaagccagccgtttaacaccaggtccgccccggataccagccccaggatcacgatgaacacgccggaatacatgccacgcagcgcgccggccaggatatgccccgcagccagcagatacatccgggtgggggaataaaaataacattcaaagcttttttcatggagccgcatcacgctgatacgggtggatacggacgtatagctgttgcgcatggtggtcatggccagcagtcccgggatcaggtaatagagatagggccgcccgcccacatccatcattctccccaggcccatcccaaaggtcacgaaatacaggaagggggacaccatctgtgaaaatgtgacccgccagaaacgtctcttgaggaacagccattccctccatagaatcgtggttatttccatcctcccacccccttgctggtgtggtggaagaacacatcctccagggtggagggcagaacgctgcatggcacatccagggaggccgccctggtctttgcctccggcaggcttccaaaaaactctgccttcatccgctcatccttcccttcgtattccaccttaaaaggcccgatttcagcaatcagcccctccggggtatcctcccggaatatctttcccccgtcaatcagcatcacgtcatcgcacaggtgctgggcctcctctatataatgggtggtcaggaggatggtcttcccctccttgtgctgcatcctgaggaaatcccagatatcccgcctggcattggggtcgatgcccaccgttggttcatctaagaacagatacctgggatcatgtatcagggccttggcaatcatcagcttgcgcttcatgcctcctgacaggctctgggatacccgcctgcgcacggattccaggccaaggaagcttaagagcctgtccgtggacgcagcaatatccgcctttcccatccggtaaaggcggcctgcaaattccatattctcttccacggtcagctccttgtccaggttgatgtgctggctggtaacgccgattgcctgcttgaccgccaccgcgttccggtccatgggctgcccgtcaaacaggatggttcccgtatccgggcttaataagccggtcatcatacgcatcagcgttgtcttcccggcgccgttgggaccaagcagtcccaggaatgtcccgtcctttatctccatggacaccccgtccaccgccgtgaccgttccgaatgtcttatgaaggcagtcacacacaatcatgggtctgcctcccctgtttcttaatgatgatggttgaaagataagggatatcgtactgcttaagctcctcaaaatccgtgaccaggcgctcctcccctgttccagacttggtaatcaggacaaaattatcctccagatggttttcacggatggcctggatcagcgcctcctgattggaggaaggcttcatcagcaccacattgtcgtgctccctcaatacctttcccaggtcctcgctgctgttcttgcgcacaggcgccaccacaaggtcctcatcccaggccaccaggggcatcttcatggaatccgccacagcacagaaggatgtgattcccggtacgacctccacttcaacgcccgcctgttccatatatggcagggtgtacatgaaggtgctgtaaacagccggatcccccagggtgatgaacgcccctgtcccgtcctccttcagctcccctgcaatcagggccgcattctcctcccacatccggcgcagcttcacaccgtggtaatgcatgggatagaccagatccacaatcctggcctttgtatccttaagcaggtcttttatgatgtcaaatgcaaaactgcccgccccggcttccttttcagggcagaatatgacatccgcctccttaaggatccggtatgcctttaaggtcagcagttcagggtctcccggccccacgccgattccgtataattttcccatactccattcctcttttcgttcttcgtaccatgacatggtaacatatcaaaactcaaagagcaattctttcccgctattttaatgaaaatgtccgccaatccattcggccagggtttcatataataaatccgggtcaatgggctttgccagatgcccgttcataccagcctccccggccctcaccacgtcctcatggaaggcgtcggccgtcatggctatgatggggatgctcccggccctctcatgggtcaggccgcggatggcctgggttgcctcgtagccgtccatcaccggcatctgtacatccatgaggatcaggtcaaaggaatcaccgtgggccaggaactggtccacggcgtcccttccattgaccgcacattccaccgtgatatcggccatgtgcagcagttccactgcaatctcgcggttgagcacattatcctccaccagcagcacgtgatgccctgccagttcgggacgctgtgactttcctgccggagggcgaacggcgcgttctattccggtcacggaaagcagggtatcataaagggtggaggcgaaaataggcttggtaatgaatgcgttggctccggcctgcctggcgctgttctcaactgcaccccagtcatatgccgttatgatgatgatcatggtcccggctcccacgatttcccttatccggcgggttacctcaaccccatccatatccggcatccttaaatcaatgaggcagacgtcataatcctccccggactggtgggccagacggacgcggtttatacattccttaccggtcaggacccagtccgaccggattccaaggttctccagcaatagggctgtatggacgcagctgtccctgtcgtcatccgtcaccagcaccttcagggattccatcacatactgtttgggcgcaggcattttccccttatccttcgggaggtcaaaatccagctccacggtaaaggatgtccctttccccagctcgctctgcaaggttatggtgccgcccatcagcgtgacgagattcttggtaatgggcatccccaggcccgtgcctcctgcgttctggcccgcggacatgtcttcctgttcaaagggcacaaaaagacgctccatgaatgcgctgctcattcctattcctgtatcgcttaccgtaaaacgaagccggatcttgccgtcctttttcagcatctgccggatttccatacggatgctgccgcctttgggggtaaacttaagggcattggataaaaggttgagaaggacctggttcagccgcagggagtcgcctatcagttccgtttccgtaagttccaccagaggcacggtgaagtccagccccttttccctggcctgcggatagatgatggaggaaatggactccaccacggtctccagtttgaacggttcgtgggcaatcctcatctttccctcggaaatcttggacatatccagcacgtcattaatcagtgtcatcaggtgcttggatgaataccctattttttccaggcagtccgccacacgctgcttatcgtcaatataggctgctgcaatggtggtcatgccgatgattgcattcatgggggtgcggatttcgtgactcatgcgtgacaggaagtctgatttggcccggttggcatgttctgccacggtaagggcatctttaagggccgctgtctgctccgtcagctttttctgcatttcccttaattcggtcacatcggttatatcgatgaagatagccaggtatacagggcttttctcctgccagtcaatgcaggcagcgttcacctgaagccacaggttctgtcccttcctgtccttcacatgcatgacaaaacggaccggctccccctttagcagttcgttcctgtgggactggattgtttccatattgtcccttatgttctgtccctgaagggcatgcagctccccgtttgtattatccccgaaatactccatgaaacgggcgttggcgtccagcaggaccatgcccaggtcctggtcaatcctgtactttgccacaaaacccggaaggttctcatatgtgacggaccgctccctctgcatctgcaccaggtcatcaatattcgtaagcacggaatacgccacctggtacccgtctatatattcatctgaaaacctggtggagaactggacccagatatactccccgttcttccgcctgaggcgcgataccatctgatatccgccctggcgcgactcgagtgcctttatgacggtctgggtaaggtcatcccacagctcctggtcatcctgatagtaaaggtccggctggttatggaacatttcctcgtattcaccgcgcggccagccaatgaggtcatagtaaaattcattggcccagaccagtgtgaaatgctcatccagcaaatgcttgcttacactgaccctcagcaggttcatcagcgtgtcatattcataaccggccggcatgccgttggtcccgtcccggccggctgcgtttttcttttcctgttccgtcatcctgttggttccccctggtcctatttcttttcctgataacacccatactgtctgcttcccggtgattgcataacgcaaggtaccttgttcatgtgcatgtctttttattataattcaagtataaagaaaattcaacagacttctggaaatggcctccataaaatgataaaatagactgcatgacgaaagaattcattttattatacgaggtatttgactgttgaaaacaaaactaagggtccataacctgatttaccagtactttcttttccgcatccatttccaatattaccaatatggagataccctgccttccatcgacaccctctgccgtgaattcagtgtttccgcacagaccgtggccactgccttacagcggctgcgtgcagaaggctatattgacatgcacaacggaaggcagacaagggtcctgttcaggcagaccgatgaagaatacagggcttttatccgccagttcttttcagggcgcatggctgctgcttccgggttagccagggccgtggagatggtctgcatccctctgatgacggaaggattcatgcgcatggacgataaggacctggcatacatcgccccctttgtggagcgttccggagctgatgatgtcctctatctgttctgttatgccctgcagaagctggagaatcccctggccatgaatctgttctgggaaacctccctgtttcttggcctgatgttcatcagtaataataaagaagcttccatgaggaaaaacatgcatgtccgggaacagctggaagccatcctgtccttgtgcaaggccggggacagggaacaggttcatgaagcgctgctttattttcagggaagttccgtaaaaaaggcgttccaattcatccggcattcactggcccctatgacggaaagtgaaccggtttcctttgtctggcggatttactgggaaaggccccagatctgctatgggctgaccatgaggatcctccatggaatctatctgggggaatacaaggacgcggaatatcttccttcctatgggaagatgtctgagaaatataacgtatccgtcagcacggtccgccggaccatccatatgctgaaccagacaggcgcagcggtttccgtcaatggcgtggggacccgtatcttccctgcaggcgtacgctgcaaccttcctgacttccaaagccctgctgtccgccgcaacctgtccctctttttgcagtcctttgaaatcatagcctacagctgtgaggaagtggtcagctccacccttttgtcgcttacccggggacaatactcccagctggtctgcgtgattgaacagcaccgggattcggggcagcacgcctttaccttatggcatctgctgatctgcatcgccacccacaatccactggctggtatccgggaaatctactccaagctgtacggactccttctctggggctacccgctgaaggcatccctgccggaagcttccggatccgaccatatcatacggcagttttcagacgccatcttcctctgcctgcgcaatcatgaaccagaccagtgcggcgctgccgtgagggaaatgatcacaaggctgttccctgttgcggaagggtatctgctgtcgcgcgggatttccgctgaagaactgcgcatgtccccctccatccggcttcttctcaatacccagattgaatagcatttactttttcccacaaaataccgccccttccggattcttatgcctcgcatccggaagggacggtatgtttcaccccatcatatgatttttttccctgctcctgcccagttctgccaggcgccggttcttctcattcaccggcccgaagtccttaagacagcagatgacctgtccacaggatgtaaggagggcggccgcccgctcataggtttcatcttttatcagttcaaagggagcttccgacaccacctctgcggccagggctttggcaaccggataatcaatgtcattttcatgaaggataccggccgcaaagggaatgcccctgcgctggagcttccggtaaaccggtatcccgcttccattcccacctatgacaaagacctccggctttccctttaccggctccatctcaaggcagcccagctctgcatggtagctgcctttggaaatcccatacagctgtgtgatataggtggatgtgaaaatctcttccggggtcccgcagcgttcaatggtatccccattgacgcacacaatatagtctgacagcttctgtgccaggtccagttcgtgaagggacaggagtactgccacctgtttctcccgcaccagatcctttaagatggtcagaagctccagcttgtgccgtatatccagaaaagaagtaggctcatccaggacaatggcctccggctcctggcagatggcccgcgccagaaggacccgctgcttctgcccgtcgcttatctccatgaagtcccgtttcccaagatccgctgcatggaccagttccatggcttcccttaccttttcatggtcctcctggttcaggatccccagccgtcccgtgtaagggtagcgcccggtggcaaccacatcctcacaggtcataagctccggccgtatccgttccgtcatcagcaccgacatacgcctggctatctgtttttccgtcatgtccttcatggaagcatggtccaggtacacggcgccttttaacaggtccatctgccggatgatgctcttcagtatggtggatttcccggctccattcggcccgatcaaggtcacgatctgaccgcgcttcacgtggatttcaatccgggcaatcaaaggcaccttcccatatcccaccgtcatgttttctgtaacaatataatcctctgccatggttttctccttactgcatgccctttttgttcttcaccatcatatagatgacaaccggcgcgccgaaaacagccgtgaccgagctgatgctaagctcagtgggcgcaaacacggtcctggcaatcaggtcgcagaacaggcagaacacagctccgcccatgaaacagcccggaatgaccaccaggggcctggctgtgcccagcatgcgcttcacaatatgcggcaccgcaatgcccacaaaggagacaggaccggcaaatgctgtcacactggcggacaatatgctggagagcaggatcagcgccacccggaaccgcaggatattcacgcccatgttctgggcgtacacctcccccagctgatatgcgctgattggcttggccatccagaacaccaggagcagcgacacggaaatcacggccgccattacccggacattatcccaggacatacccgaaaagcttcccatggaccagttatgaagattgacaatgttggcgtcatctgcaaatgtgatgacaaagtcagtcaccgcagaacagatataacttatcatcacgccgcagatgaccagcatggacattttctttacccgccccgaaatcaggaggatgaaccccatggatatcatggcccctgcaaatgccgccagtatcatgcccccggaactgatggatatgcccctgccaagcaaaaggatcatgaccagggacaccaccagcctggcgccggaagaaatccccagcacgaacgggcctgcaatggggttggcaaaaaaagtctgcagcaagaagcctgacacggacagcgcccctcccagcatgacggccgacaggatgcggggcaggcggatatcccacacaatgtggtaggcggtcccttcatctgtctgccccagcaggattttccctatctcccccacggtgagatggacgctgccggaattaatattccataaaaacagcagacacatcaaaagccccaggaggctgaatgtaatgcagtattgtgtgtatgttcttttagacattgggacaactccttaccgcagcctgtgcatgtaggccatttcttcctggtccggcgcttcctcagtgaggatccgatggatatccagtatcatattgcccaggcccatggtttcctggaacaggcttttctccgtgcaccagacatttccttctttcacagctttaaaatccgccaggaggctgcttttatccaacagctgggcaagggactccagttccccgtcaatggtgctgttataaataatataatccgcttcctttgccgctgcgtaaaacgcctccatctgcatgttcatggtggacagcgcattgccgtttccgtcaaggccttccggaacataggtcccgccagccagttcaatcattttagccacataatccccggacttcctcacattcacatatccgttggaactgatgtagaaaaatgccactgtctttcccgtggcatcctggtccagcacaggcttcaggttctccatctgtttccggaaacatgcctctgcctgctcctcccggccggtaagcaccccgtacagcttcagccactccatccttccaaggggatggctttcatagctggagcgctccaccagcacaggtatgcccagctgttccagctgttcctttacttccggggaatggctgatcatggttgattcgattgccaggccgcatgactttgataggatcagctcgtaatcaggggcgttgtatttgccggcatagaacataccgccatcttccagggcctgccttgcctcttcaatataccagccctgggcgtccgtgccggacagggtaatccggtccatggcgtccaggctcttaaacaggtccatggccgaggttgcaaccagatagatattcttaaccggctgccgcaggaccgtcacatcctccggcaatccttcgggctgtgttccctgttcaggaaccaccaggaaccgcccgctgtccctgatggatatcatggcgcatccgtcgtcatagtaatccacggaaaactggtccgcgtacagaagttccatgctgcggatgacttcccggtcatcccaggaatccttggatggctgcggatgtgctgtctgctgactgcctggctgcggtcctgctgcctgctgctggcctggctgtggccctgctgcttgctgtggccttgtcgccggttgctggcctagctgtggccctgctgcttgctgtggccctgctgtctgctgctgtgcgcctgtctcccggcctggcgcggcgcatccgcaggcagctgccatcagaagacagattatcatggttgtggttattatctttcctgttctcatcactgaacctttacaattgtggctgaatcaatgatcagcccatactcaatctcatggggttcactcatggctaccgtatccgcgataaccggtatattcctgtcaaatacagccaccggaatctcaaacgcagaattgccttctgtacttatgaggtcaaacttcccaccgtccaccttcatataatcgtagttggcgctgccccagacaatggttgcaaagacatttccatcttccaccctcagggatgcaggggattcaacggaggcccttccggacccgcctgtcagggcaacctcagccgtatacatcccatcttccaggctcaggcttcctgccgttgtgacatttccctcagcaaagcattccggcggcagggaatcagagcggaacataaggacacggtcataccatttctccttctttttgctgaatgcactgcagtcaatttccatatccagggctttgacaggaaccttaaacgtatgcgtgccctctgccgtctccacatatgggatgaaatcagcctcggaagcctttcctgccgcctctccagttcccatatacagcttcaggtatccggtgcctcccatggtcatgaccgcgctcatggtgccgtcctttaccgtgagttcgcaggcggtaatctggaacatgttggagctggattccacttttataggatataccccgtcttttatctcatcagcgtatacaggtgtctgttcattggcttcactgtccggggtcctgggagtggtttctcctttatcctggtctgattcagtttctggcgcctgtgttacggttgcttctgcctgtgcaccagcccctggctcctgtgccccgcttccttctgcctgtgccccgcttccaactgcctgcgttccgcccccacatcccccagccaaaagcatcattgcaatcatgactgcagataatcctgcttttttaaatctcatcttcattccacctttaaaagggcgatcagcaacattgtcccgaccgcccattcttcctgttttacctgataacctttttacctgataacttttttacccaatcactttgacaggctatccactgccgcctgtgcgtgttccacaaaaagctgctggattttttccatctccccaaggccgcgtacaaggcacgtcacctcatagccagcgccctcaaatgcagttttccatgaatcctccccgtcccccgccatatcgttgttggcatggtcgcctgccactatcattaacggctccaggactaccttcttataactgccttccttaaccttggcaaggacatcctccagaccaggctccgcctcaaccgttcctacgtaataattcttatatcctgcatctgccagcatatcctgcatctttgcgtatacatggttggaatccgcctctgtaccgtgccccatgaagcagatggctgtttccccgtcatcgtactcagccgttgcctcggtaacagccttcatgacagctttaaaatcatcatccgtggtcagaagcggcttaccgattgccaccttatcaaaggcatctgaataccccgccacttcattcacaagatccgtatactccaggccgtccattaaatgggtgggctgaatgaccaggttcctgaccccattcttctccgcacgttcaagcgcctcgcccacattgtcaatagcaacattgtcacgtgacttcacatggtcaatgatgatctggctggtaaatccccttctgacagagtaatccggaaatgccttctccattgcatcctcaatggcccctaccgtcaggcgcctgttatcgttgtagctggtgccgaagctgaccaccagaagctcatcctcaccaatcccgtcctggttcctggtgttatccttggaagcatcacctgtatcatagttctcttcatcttcttgtgccattgcgtctgcagcctcctctttacctgattcttctgccgtgttttctgctgctgtggtttccgctgacgtggttcctgctgtggtttctgctgccgtccctgtccctgcaccggatgccactgcctctgtttcctttgtgcctgaacaccctgccacggctgatgccgtaagggctgctgctgtaagtaatactgccagtttcttgattttcatcttctcttcctccttattttaaaccatatcggttccggaaccatcttagggcgtgtttgaaaattcatgccctcatgatgatgcatcgggagcacgtcctttgacggcaatccgacaagatataggaatacgccagaagcagctgaagatttccccagtacggcagacacaaaaaaacacagggaacattccctgtgcatctgattccttcctcacagggacccgcatgccctgcggaatcgtccctgggctgtaaatacttataaccataccctgaagcagatttccgcaaaagcagtcattcaccgtctgagtcagaaatctgcggtcataaacatgcctgcggggtccatttccccatatatatcaatcatgatatataccaatcacggtggaaaggactgcccaggcgcgcttcaaacgccgtaaaccggtacgaccaattactcgtggtctggaaccatattcctgtaccaacagctggcaggtttcctgacttgccgctcaacacccataaccgccttcccaatccggaccggatcagtggctgtacatgacaatggttatgggctcccggcttacagtgacgagatcgtacaggattcacacctgtttccctattacccggcgcctggaggatcggtcatgtctccatgacgaagcttcagccgccggcaccagctgctctaaactcgatatgctatatcctaccatctattggcagaaaaagcaactctgttcctgtggtcattgataaaaagaaatatcctgtatcaggaatggcacattataaaatcggtcttatttttttctggtattccctgtgaaaacaaaaaatggaaaataacaccgccactgtctccgatatccacgccgcataccatgcgtaattaagtccataacgggatgcgatgaatcctgccatgggaaccagcagcaccagctggcgcatacaggtactgagcatgctgaccatgccgtttcccagtgcggagcaggcaaagccgatggtgatggaaaccgctgcaaccggaaacgtaatggacatgatccggattaaaggtgtaccgattgccatcagttcatccccggcagcataaaggcccagcagcctctggggtatcaggaaaaacaaggccgcgcccgccagcatgatacacatggctgccgtaacggttaagcggaacgcggtcctcacccgttctccatttttggctccatagttgtagccgataatgggcagcagcccctgggccagcccgctgaccggcatatagacaaaggtccacagtttataatacacaccgaatgcagccactgcagcggaagcaaagcccgtaaggatggcattcatacccaccatcataagacttcccatggtctgcatcagcatgctggggatgccaaccttataaatcccaagtatcagatgtccatccgggcggtatccctttatcttaaaatggatttcatgattcatccggcggttcagccccaaagatgccgcagcagccacccactgtccgatcacagtggcaagggcggctccgggaacccccatccttggcagtccaaacaggccgaatataaggatggggtccagtatgatattggtcaccgctcccccaatctgcgccatcatgcttaaaaaggtattgcccgtggcctgaagcagacgttcccccgtggtggccaggaagattcccggacacaggagcatgcagatccgcagataccgtacgccgaaatccgcgattacactgtcatcggtaaatgccctgatgaatgtcccgcttgcagccgcgcccagaacaatgaacaccatggatgagaggactgccagcatcaggccctccgtagccacctgatttacctcttcataatttttctgtcccagcttcctggacaacagggagttcacccccacgccggtccccaccgccaccgccagcatcagcatctgggcgggatacgccagggaagtggctgtcagcgcgtcctcactgatcctggatacgaatataccgtccacaatattataaagggactggaccagcatggaaatcatcagaggaaccgacaaacggaagatcagtccccccaccggggcattccccatcttattctcttttactgttttttgctccaatatcttatcctcctaatccaatcagcccatattccggtccaggaaatcaaaacacagatcggataaccatggctcatgccaccagttcctcccatggtggggtgccccatccccggtatataactctgccttatccggcccggcggcctgctgcagcgtcctgaaaaatgtctccgactgctcataaggaaccacagcatcaccggtcccatggacaatcaaaaacggagggattgctttgtgtgcatatgtacagggattggccagcctgaccagttccggtatctccggaagagggctgcctaagaagacggattccggggagtccggcagattgtggtccggcactcctttttttgtatgttcaaacgcctcatccatggcaaggaagccgccgcatggcccgcaccagtcaatgacagccgccacccggcagtcatacccgccatttcccatggataaatcctcaaatgcgggattgccctccgtcaatgcagtgatggacaccagccagccgccgctggacggtccccacagcgcaatccggtccggatccagctggtaacgccgggcattggctttcaaataacggattgccgctttcgcatcatacaccatggccgggaagcgggactccctgcttttccggtattcgcagtccaccaccacatatccgcggtctgtcccgcgcagcaccggctctgagctgtcctctcccttgcccccatgcatgaatcctccgccgtgaaaaaacaggatgaccggataaggaccttccttctcctcattgggataccagatatccagtttctgggactgtgaatcgccactgtatgggatatcaaactgtttcctcctgatatgcccggccacttcgggtgataacatgtgatttaccgtctgtttggctgtctcaggtgataacatatgttctttcatttactgtctcccgttctccaatgtatgcgttccaaggactgcagataccgtcaaacgcaaatgccagtcaatagggtgccaatccacggtatcagtccgcatcatccggcagttcatggtattcctcatataaatcagccaggaacacgcccagctgctgcgcttccaccgtgctgtgggtgattaccttctttaaatacgcgtcactgaacatgtaatccggcgtcgtatcatccttcacgatttttccgtccctgacgccgtagccgatccattcacggctgcatttctccatatatcccagtggactctgtctggaaagcgtcaggcacagatgcatgccgcctaactgtttatgttccgcatccatggtgtggaacgtctcatatgcgcagtccacgaagcagccagccgctttcagttcctgctccttctcctccgtcaggccaaattccctcaggttgattgcatggcgtatggtatacgttttagcctctcccgcccccaagtccagggattccacggtccagatgccatcctgcttatcctttccattgatgaacccatggcccacatggtcggccggattccatatcttatacttgatattatcatatcccatgggccccacaggctggctcttcggcgggatattcagccagcggaaataccaggccagcatcttcggcgtgcatctgggataagttgtgtacactgcgatataccctgtgccgtccggcatgtggcagtatccgtattccagttcctgatacccctcgggctgcagcagattcagccagttttccggcaggatggcctttgccggatctgcagggcatccccgctcaatcagttccctctcacggggcgccagctcatataacggcaggtcatagtatttggcaaggggaagctccctctcccttgggtccagttccggtcttacttcgatgattccttttctgctcatatcattatcctctttctgtttattgtgcagccgcatcgtccatcccggcccggaagaactggatggccgatggcgatactgctttatatagttttccggtggattctaacatcccgttttcatggatgaagaatgtggtgatatcccctgacaccatattgcccgataccaggaatctgccgtccggggaaatgttgataccccttggaagattgccgccggacggtatgttctgctttactgccgggatcccgtcctccccaacggaaaggaccacaatctggttcagtccgcacagtgtgacatagagtgtccttccatccggatggatcaggatgtcctgcgccccaaccggcttcccttcaatcagccccacctcctcggacagcagtttcaccttgcagaacagttctaacttacctgcatcctcgtcgtagtggaaacagttcagctgcgccaggttttcattgttggcatagaataccggcagggtgggatggaaggtgccgtatctggggaaacaggcaacctcctcggtcacatactcatccgtaatcacaatcttctcctgattgcggtccagcttaaatgcaatcagcttatccatccccttgtcgcaggccacgaacatccctccgcccgggctttggaccactgcatggagcctggagatgacctggaccagctgtatgtgattggtgaccgggtccacgttcttgcgtgaattcggaccgtttccgcccgttcccggggttatggccacatcgcatacatcacctattcctccatcttcccgtatcctgaacatcacgattgcagtatcgtcaaacaggacttcattttggaatgtcccatcctcattcttctttattttggtcacatgccagggatccgcacagtggcacgtaaggagatatttccccgacttatccagacacagataggatggctcgggaagcagcgactccttctcattaatcagcgtaagcccccctgtctccgggttgatacggaatgccagcagatatccgcctccgccgatttcccccctccgctccccgcattcattaaccgcgtacaggatccggttctttgcgtccagacacagctgtcctgcggcaatgtcatagcggatggtttcaatcagggccattgctcctgtttcctgattgaactgaaagatggatattccctttggcgccggagcaaatccccagtttcccacgtaagcatatattttttcagtcatactgattctcctgttttcctgttatttcatattcacatcttatggattgatttccctggcccggcagcaggacacaaagtgtccggggctgatttcttccagcctctggggctcgtggcatctttcacacacatggacgcagcgggccgcaaaccggcagcctggtttgggatcaatgggggatgtaatctcgcccttcagtacaatacgctccatcttcttatcgatgttaatggacgggatggcggaaagcagcgccttcgtatagggatggtactgttttttgaacagttcctttgaaggacaggtttccaccagctgccccaggtacatgacgcatatattatcggaaatatgctttaccacggaaaggtcatgggtgatgaacatgtaggtcaggttcttttcctgctgcaggaactttaacagattcagtatctgggcctggatggacacatccagggcggaaacaggttcatcgcacacgatgaactcaggattcagggccagggcccttgcaatccccacccgctggcgcctgcctccatccagttcgtgcggataggacatgcgcagcctgggcgcaatccccaccaggtccataaggtccgtggtctttctctggatttcacttttattaaatttacctgacaccaccaggaattcccggatggattcttccacggtatatcttgggttcagtgaggagtatggatcctggaaaatcatctgcgcatgctcatgatagtccttcatatcccgctttccaagtgtcgtgacatcctcgccttcaaagaggatgcgcccatccgtgctttcaagcagatggaccagcatgcggcccagggtggatttcccgcacccggattcgcctaccacgccaagggtggtgcctttggggatggtgaatgatacgtcatccaccgcatgcagcgttcccctgcctgttttaaaatatttcttcagattctgcacttctatcagatgatccatccctacacctcctcccccgccttcagacagcggcacaaatgtcctgacgatacttccttaagcccaacctggctgcatttacaggcatccgatgcccgggggcaccgcggatggaatttacatccttccggcaggctggtggggtccggcggcagcccgtctatgggctgcagccattccacctcctggttcaccttcggcagggcgccaaataatccaatcgtataaggatgggagggtgacttaaatatatccctaagggagccggattccacaatctcccctgcgtaaatcacagccacctggtcgcacatctcggcgacaacgcctaaatcatgggtaatcaggatggtagtggtatcattctcccggttcagctcccgcatcatctccagcacctgggcctggatggtcacgtccagggccgtggtcggctcatctgcaagcagcagctgggggttacaggccagggcaatggctatgaccaccctctgcttcataccgcctgagaactggtggggatattcaccatagcgttccgcagggatccccaccttctccagcatggcctgcgcccttttgtacacctcgttcttgggaatatcgctgtgaagcgcaatcacttccgctatctgttgtcctaccgtgatgaccggatttaaggatgtcatggggtcctggaaaatcattgtgattttctccccgcgtacctggcacatctcctgttccgacagttccagcaggttgttcccttccagaaggacagcccccgatcttaactgggcaggcggctcctggagcacgcgcaggatggtgcgggcaatggtagtcttacctgccccggtctccccgaccagtcccagtaccttacccttttccagctgaaaggatacgccgttcaccgcatgtacggtttcctctttggtcacatattctacatttaaatccctgacctctaaaaatggtttatgttcgctcatggcttctcctcttatttcttaagctttggatccagggcatcccgcaggccgtcgccaagcaggttgagcgacaggaccacgatcatgatgcagatgccgggaataagacacatgtaaggatattccatcaggaaattacggctgtccgccagcatggccccccattccgggataggcggctggaccccgattccaatgtagctcatgctggctgccatcatgatcctggcccccacccccatggtggcctgcaccagcatcggcgcaaaggtattggggaatacatgccttgccatgatacggatgtcgctgcaattgccgatggaggcagcttccagatattccatcttccttacattcaatatggaggaacgcatcagcctggctgaacctgcaatcccctcaaatcccagggcaagaatggtattaaagataccaggccccagggcgcaggccagggcgatgttgaggataaggccgggaatggactggattacatcacagaccctcatgatgatgttgtcaatccttcccccgtaataaccggacacagccccaaatacaatcccaagtccggtgctcagggccacggagccgataccgatggtcagcgaataacgtgccccgtacagaatacggctgaatatatcccggcccatctggtccgtcccaaacagatgggccgcactgggtccggtcagacgctctttcacgctgatggccgcataatcatagggtgcaagaaccggtgcgaatactgctgccaggaataccagaagaaaaatgattccgcccagcatggcccctttgttataggatagctgtttcattatcttaacaaactgattctggcgtctgggttccagaaccgcgccttttacattcaattcacttgtcatctttctttccccttttcctgcttccggtaatctgggccttgacacgcgggtctaccgctgctatcagaaggtcgcagagcagcataatgatggaaaatgtgattgccagaaggattacaccgccctgcaccacaggataatcacggttgttcactgcatttacaatgtacacgccaacgccgggaatggaaaatatggtttccgctatcagggttccacccagggaggtgccaaaactcatgctggccaccgtaatcacgggaatcagcgcattgggcagcgcatgtctgtaaatcactgccttctgcttgacgcccttggcctttgccatggtgatatagtccgcatgtatgacttccagcataccggagcgcatctgccgagccatggtggtcattcccgcaaacgccgtggatacgattggcaggatccagtacttgattcccccaatcccataggcgggaagccatcccagcctgctggagaacagcatgatcagtaccagggcaaaccagaacccgggaagggaggtgcccaccagggccagggacatggtcccataatcaggaaaacggttctggtggacagctgccgtgacgccaagggggattccgatcaccaatgacaggaccataccggataccgcgaaaatcagggtcttgggaaatctcgataccatttccgaagtaatggaaacattggtgatataggaggtcccaaagtcaaatcggatgaacacgtcgtaaaaataccgtcccagctgtacaatataagggtcattcaggcccatggattcccgcagttcgttaatctgcgcatcggttgccgtggttcccagtatgacctgggccgggtcgccgggggtaagctgcatcagtgtgaatacaaggactaccacaccgaatatgaccggtatcatgagcagaatcctctttaatgtatatttaagcatattgtttatctcctcctcacaggcagggatgcatgattaatctgccagctcaatggtattcacgcggatgaagcggttccagtccgtatagaatcccgttacctttgccgaattataggcggcgtaatcaggcatgctgtagatttcatagtaataagcgttatctgtgatgtaatcataaaatgcgtttacattttcctgtgtatatccatccgcagaagccagtgtatcgtaaagggactggagcttatcgtccagcaggcctgcccaggtcctgccggaatcataattcttccggttgaacagggtgttccataagtcctgtgtggcgtatccggaattgccaggccctgcatatgccatctcatactggccgctggtgccgtccctgtatgcgccgtaggtggttccctcgcacacattcagctccgcgtcaatacccacatccagaaggttggcctgtatgatctgccacatggtcgtaatggttccgttgttgtttgccagaagacgcagatgcagtcctccctccccgtaaccggccttggcaagcagttccctggccttatccgtgtcgtacgcatagggactgctctcccatgagggatcataaccgatggtcagctctttgctgccgcaggtcaccttactgggttctgcatatccatagccgcatgcctctgccactgattcattgtcaatggcatataacacggcctgccgcagttccagattatcataaaacgggctgtcctccgtcatacagaacatgatgcctctgtcctcggaagagggcacaccgtaaatttcaataccatccttggctgcaacctcatccagcatacttggctggatgaacatggcgacctggatgtcgcccttttcaatggccagcgccagctgtgttgcttcctccagtatgttaaattctatgatatccgcattggccacgcttcccggataggccagctcatccgtctgccagtaggaatccgtcttctcaagggttatggaggttcccgccacgtagttgctcaccgtgtagggcatggtgccgcaggatgtggttgcaaactggtccgggctgtcattgtatgacttctcggtggcgattggaactttacacacaatatactcaaatgcacctgccgctgccgtattgagtttcagttccaccgtgtactcatcctttaccagggcctcctccaccaccgtggcccagttcttattgtactggttaaagctgaacaccacgtcggacgccgtaaccggattgcctgctgcgtccttaatattgtcataaatcgtgacatcgaaggttacatcatccactttctcataatccttcatcaggatcggttccagatccgcggaaccgctctgacagctggccagtgtctcatacagtgtgtatgtgaccatatcctttgtaatacggccgctggtccagggattcagggaatccagtcctccgtacagacccacggccagctttttcttcccatcggccatgtcctggctttgttccgttccggcggaagccgccgtcgccgtggtcttctggccgccaaaaccgcagccggtcagtgatactgccattgcacaggccaacattgctgcaatcgttttttttctcatttgtctcattcccgctaccccttttctcttattttgcccccgcaaaatgaatgtttattgttctatgttttctctgaattatcgtacaatttcactaactttctctgttttatccctcctttattatgcattttatcatcctgaccgcattttgtctaacatctatgtacctgccaatctacaagtatttacttgtatttcatcacctttccatgcgggacgtccgttgggaatacacccggtacatccgggcagccccaaacagcaaaaaaggaaacaacattgccaattcagcaggcaatgctgtttccttctttttgtccggcgggaacccgcggacacttaacatctcataccgggcgcgggttaggaatacggatgcatccattacctgatcagacatatggccccaaagaaaatcccccaggcccccaggcctcccaccgcaatcttcacatagcggaaataaaccgcctccatatgcgcctgggccttgctggctgcaggtttcccggaaccattcccggaccctcccggcatcttaaacccatcgccggccgtcctcctcataaaccttcccctcacctgcctcacagcagccaggctgcatggaatcaggacggcggaaaaaaagagccaggcaaaaaatccggtaacagccacattggacagcaggtgcaggacgccttcctgcatgtcaaagcgtatgaagaaactcacgtccaccgcaatcatgctggccgtcagaagtatcatgctccagaatataatccggcagagaagcggcaggaccggttcctcatacgtgcggatgatccggttctgcttattcaggttccatttatcctgtccttcccaaaaatagcccatggatgtcccctcccttacacagtccttattgccttaatccatcttctgctctttaaacgccatatacaccagattgtctttaagatattatccatcctcaggcatatataaatccagaataccggggcatgccatacaaaacctgccagaagccccagggggatggaagaaatccataaaaacagattatccgcagccaccagtaccttggtatcgccgcctcccctcaatgcgcctttggtcagtatcatattggatgcctggaatatcatgattaagctgaccgcatacatcagatgccttgtaatcgccgccgtctcctcagtcaggcggtacatgccgaccaccggctccgtaatcagcaggatgattgcagccgacagggtacccagcaggattccaatcccaaggaatgcccagccctgacgctccgcctcccgtatctgtccccggcccagggtattgcctaccatgaccgaactggcctgggacacgccctgaatcaggttgccggtcagcctggagatgacggagacgattgcattggccgccacaaaagccgtgcccaggcgtccaatcaccatcatgaccacattttccccaaaagaaagaaggatatcgctgatcaatacaggcagcccaaaatggacatattcccgcacaagtccccctgtcctggcaaacaggtccctaacgcggaacctgagcttattctctgccagaagcagatacccgcagataacggagcattcgtagatacgcaccagcagggtgctgaaagccgcgccggataaccccatggccggggcgcccagcttgccgaacatgaatatataattggctgcgatattgatgaaaaaaccagctatggacacatacagggccagtctcacctttctgatactgcgcaggatgaccgtggtggttatggataaaccattgaaaaaataagccaaggtacagtatttcagatattcggtcccataccgtataacctgcggctgtgcggtatacagcctcatgattacccccgggaaagaaaaggtaagcaggccgaacacggcggccaggaccagggacaggcggtacatgattgcaatcacttttttgagggaatccatatcctgcatcccccagaagcgggaagccagcacagaggcacccatgctgagtcccatggaaaaggaacggtatgtattcacgaactgggtggccaaggatgccgccgacagctgcagctcccccaaagagccgatcatcagggtgtctgtcaggttgattccatccgtaatcatcccctgcagggcgaccggaagggcaaacagcaggatttccttataaaatttcccatcatcatataccagaggtcccggtttcattttcatgtggattcctctttagcagatgtctctttaacagatgtccctttagcaggcgcctcttttgtgaacagacctttttcaagacggcggcaggattcctccagcgccggtctgatatatcctcttgccatgaagcagcttttccttcccggaaggctgcgccggatatcccgttccagggtttcatcatcaaaaatgtaaccgcttggaaccatcaggctgcaatcgtgattgatgatgacggtttcccctgcatcggaaaccgctttaagggcggttcccagtgaggaatacagttccccgctggctccaatgagggccaggtccccaatcttcagcaggtgcatgcgcacctcataggacgtatccatgggccttccttctgagtcctcagagggaatccttatccagtcaatccgtccatgtaattctgtattttctttataggaaggcaggtgcctgattacctggcatacatccgcatactgccgggccgacaggttttttaaggctgcccgggccatctccccgtttttgaggatcagacgtgtctgacggcctgtttttatgtcgggataatagatttcgttgcccatcaccggattgatatcccctgccgccccgctggtccagagggccacactgccgccgtacgcttcttccagataccggcagacagcacctcccacatcggagctgaccgccggtttcccgtccctgccgcagggattctggatcatgacgcagttgtgcatgggataattgaggaagaagccgatggtgtccccctccggcccatccaccttcaagacgaacatggtccggtccacggcctttcccggattgattcccagtccgcattccgccgtaacatgaccgttcccatcttttacataataatcctgtatcctgtccacattgatacagcattcgccggacccataggtaagcctggctggacgttttccggccacggcccggcctacggcctccatcatgcactctgttatgaatgcttcatatcccgcggttgcctcctgcacatggcgcggcttcttactgatatcattgggtccttcattaatccggattccggtcacaggagctgtgtgcgtatgtatgctggtaagtattatgttctgttccggtatctgaaaacgctgttccagcgtttgcagaagcaggcccggatgaggcaccttgtccagatcgaatgtaactatcagggacttttcacagccatcgtcaaacagcagcgcccttacgtacagatcatccaatatccctgtgaattctatatcctgaagcccccgcaaatccttcagccattcctcccggggggtgattttcatttttccggctccacattgtaactgctctttcatctgccctccaactttctcaaatgatatctccattatggatgctgctctcccagcacctgttcaaacagccagtccctgatttcctctatatcataggcaaaatgcatggaactgttatgctcattgggcgtctcttcctccggattcccatcccatgtggtcccaagcctgaacatggtatagtggacaggactcccctgcgcgcgcatgtctgccgcggcccgggcatattcttccctgctccacctggcgtcccatactcctttggcaacagcagccccatctgcttcccatgcagccacgctggcattcatccccggataccctctcttatccccctcggaaatgatgatccagatattctcatccttcatcacacgcatggcatccggatccgactggccggcaaccagaagcagccctgcaaagaagccgggataccgtatatccatatcaatggaacggatacagcccgcggactggccgctggtataaatgcggcgggagtcaatcctgtattcagattccagctgcccaatcaatttcattacggtgtcattcatggtttccggtgcgtccttcctgaattgtggtgccagcacgaagcagggatgttttgcctgttcctccggccctgcccagaccaccgccccatttccctggcgcagggttatcatcacatcatcaccgtccgcactggcatccgccatgaaaagaatcaggggatattccttctgcgtactgtagtcctccggtatatatagattatacatcagatattcccctgtgtccgggtccctgaatattttttgctgaaaatcatccactgtcctgtttttgacctctgtattcggataaataccaccattgggcagcaatgggatatcctcttctgtcattatggttttttcctgttccacactggcataaacagctttgaccacgccggatcccgttgtccccgtaggcccgttaccaccgtttataatacctccttcatagacagaagacaattcatctgccgtggacagctccaatatcacatatctgccatcggtccccgcatctgccctgtcagcttctgtattggcgtacgccttcataatggtgcgtccctggacaaaaaagctgtctgacgcgacggaacggttctggatttccctgtcatattccaatatcaccgccgttatcttctggccattgccgaatacctccgtgacagccgtcacctgcagcggctccccatattccacctcatatcccgtagccgctgccttctgataccacgaatccgcctgctgccaatccggttctgttccctttccgtattcataaaggccggccatgcctatcatgcccacggctgctgtcttatccccccgcccggctgccgtttcataccactgcatggccatgccataatcctgaggtacgccctgtccaaactcatacagccgtcccagataatactggcttgttatatccccacgctctgcccccagctggtaatatgctgccgctgctccataatccttctgtactcccagacctttctcaaacatcaatcctgcataacgcggtcccttcctgtcacctgcacgtatggattccatcatccattccattgctgtctgataatcggttccgacgccattgccggtaaaatacagcaggcctatgctcatcatggctttagggcttccctgggccgctgccttccggtaccactccatggcccgtcctgcatccgcagttccatattcccctttctccagatcctcccccagctgttcctgggctttcagatatccggccccggcggagtccttaagataccgcattgcctgtatcatatccccggatgcctttgcctgtccgtactgccggtaatactgctggccggcctcttcttccccgtccccatccgacattccggttcccccggatgccccggccacttctgatatcccagtcattgccggtgccccggatacttccggcgtcccaggcgtcccactcacttctgccatcccgctggttcctgttatacaggaaactgtcattgccatcccaattgtaaacaccatctttttaaccacaagctgtatccccctgttcctatacttttaacaactatatttccttgtcttagctttacaaatagaaaggtatactatataattattacaaccatttacttgtaattcaaatcaaccgcatcctcatatatggagggaaaaatgaactttttaagcctggaatactttctggtcattgcagaagaaaagaatttcagccgggccgcggacaagctgttcgtatcccagcaatctttaagtgaacacgtcaagaagctggaacaggaactggggacaccgctgtttaaacggggccgctccctgacgcttacggttgccggcgagtgtctggttaccggagcccaggagatcctggatgcccagtcacgtatgctccagcagattgcctttgtgacagaaaacagacggaagaaaatcacaatcgctgtctctacctttgatgtcccgcccttcctgcccgaacttctggccagatataaggccaaataccccaattatgacgcagtggtggtaaagcgccaggtttcggatatcgcttataatatgagcggtgtggacctatatatcagtttccttccccttaatcccaatctggagaacatcatcctgagccaggaccactttgtagcgatagcctcaaaggaactgttctcccagacctacggaaagaaatggaagaaactggaacaggaactgcaatcccatgaagccctctctgtcatcagggatatcccatttatcctgctctacgacaagaacggcatcctctcccgggatttggaccatatctttaaaacctaccacatcaccccgcgggttggtttccagtctgagaataatgaactgaacgcagagatgtgcgcctgcggcatgggcgtcatgctggccccctatgattactgcatccgtaaattccgccttgactcggatgagaaacggaaccaattcggcatttatccaatacagacacctggattagatgcatgcatcgccatatcctatgagaaggggaggcatctgaatccagcggagaaacatttcattgaactggccagacaatatctgagtaatccataagtattgggagggaatgattttcaatcatccctctcctttttgtgtacacattgcacaattatgatagttttcctttacattcatatgtctatttaactataatccgacaaaaatgtccaacaccgtcaagcctttggggttacaagcctttccttgtacaaaaatcccctttctgtgaaattatttcaagtaccatgggacataatgacggatatttggtatactgaaagaaaatcccatatattcctaatgggagaagggggatgattggcaaatgaggtacgtatttcctttcctgtggattgtaatatatgtccttctctatctgcatgagtccaaggcagtccacatgccgggcataaaagaggaggagtcaggcacccggacagaatatgccctgagggcttttgtaaaagcgggtatcctgtttttaggctggtatgtccatctgcccttatttatcgtgtatctgttgatactctgcgggtatgggatgacgttccggtcaatcaggaccaggaataagatggacctgtttttctggggcaattttttcagtatctgcttcaccgccgttcatctgatctgcctggccgtcatctcaatggttaccggatatatgctgagggatgtctatctgaatcatatgaccttcctgctgtccatggtcatgaccctcctcatcctgaacctggcccacatactgtggaaaagacaggcctttgtggaatggatcacgcttttaaccagtgatgaaaagagattcaaccagctggtctcttttgagtggtatgcggtgggatatctgctgtttgacagcatttcctgtgttttcgtactgccctatttcctgttatccgtttttctgatcggcagctgcatccttctgataatccagttcatactttttttggtacatacttacaggatcatagagaaggcccattatgaagcggaatactacaggctggaggaggaaagggccgaccatgtaaagaggcagatgagcctgcagaagctggcctatatagacagcctgacaggggcgtttaccaggagatatgcaatggaaatgctggaatccatgcagaaggacaggctggatgtcacggttgcctatattgacgtgaacgggctgaaaatggtcaacgacaccctgggacaccccgagggcgaccagtacctgaaaataatagcaaacagcctcaatgaaagcctgaataaaagcgatatccttgcgcgggttggcggtgacgagttcctgattgtctccaacagcacggaaaaagacgctttggagtccatgctttcaaaagtcaatgaacgcctgaaggacatgggccgggaaggctacaggccatccttcagctatgggaccgtgtcggcgtcccatcatgaaccctttgacctggatgcattgttacgcgaaagcgaccgccggatgtacgatcataagatgcagtttaagaagggggtaatctaaatgaggctggtactgccctggaacggctattataccatgtttgtggcaatctgttattacatatataatcaccagatgttctcctatattgattatctcacggggaagaagcttcccaaatggaaaagcagcatcataaccttcatcatcaactacgaggtgttcatgctgatttcccagctgcgtttttacctaatcatcaactggacgattttcgccatcttcctggtgctggaaattgcggtaatctaccgggtgccgtggaccatgagcctgttctgcggtatacagggcgcaatgatcggcctggcatttaatttcatcacaaggtcgggcactgccctgcttgtgaaccagtcccttgcggcctttgactcccggatcatgagcagcatagccagcttgaagccctatcccattgcggcaggctttgtacttgcaggtttcggtttttgggtgcttcagcataaatttaatgactgggcggaaaaagaggagaatccggacaagccggtaaaccttattttctccctctgccttgtgctttccctttttatttatctggacctgaacctgctgatttatttcacccccagcaatgaaccgatcataaaactctggggaatgaaatcaggcatatgcgtattgattgggtattatatcgggattagccatatccataccctgacaaagctccagcattttgaaaggcagagctataccgtgcgcaaagagctgatttcacataaaatcatggtggataaactggaaaagctagcgttttatgatatcctgaccggctgccagagccgtgaagcggccttgaatgccatgaagcatgattatgaggaggggaatcccttttacatatgctttgccgacctgaataacctaaagccggtgaatgataatcttgggcatgacgccggggatcggtatctggcagcggtggcccatgccctccaggaagcggcgggaaccggggacattgtcagcaggtacggaggggatgaatttttactgatcacaccccaggacgggattgaacgggtcagggcaggcttggataatgccaagtggtccttaaaagagctttccaattcgtctgaatatccatttgaactttggataagttacggaattgccttcagcggggaatgcggggatctggaggaacttatcaagcttgcggacgacaggatgtatgagaataaacgccgcgataagcaggaaaggaatatcggccaggcaggcccaatcccgtttgggccttcataaaagcagtccggcacagtgccatcccttataggcactgtaccggactgttttctgtcatacgagtctgattttcaggttttccatgttacgttgcgggttgactcaccttccattaactccgccttaaacacccgcttctgatggtccgcatgattgcgtaccacgtcaaacaggatcttaatggtggcttccgccatctcctccactggctgccttatggtagtcagcgtcggattatagtaatgggcgatgtcaagtccgtcaaatccagccaccgaatagtcttcgggtatcttcatgccgtgttccgtgatggccttgcaggcaccgatggcaatactgtccgatatggcatacaccgcggtaaaatccgtctttttttcttccaggatccggctcatggccataaagccgtaatccatggtgtaacagtcccttcctaccccggaaaaaatgcagagattttcatccggttcgattccattgtccttaagggccttccggtatccctccagacgcagctttccgatactctcatcgtcctgggtggctgccaggattaaaatcctcttatgtccaagcctgcacaggtaatccgtcatcttatagctttccgcaaaatcatccacggaaacccaggaatagaaggaggcgtcttccagggaatccgtcatcccaatcgtgctgagcacaaaggggaccgtcagctgttccagcttctccttactgtgtgagaaaaatcctcccaggaacacaatcccccggggcttcttttccttaatcagttcaagcgccacatccacctcgtcttctcctgcatccacatgctgcatgatgaacgagtacttcttcttctggatttccttttcaaaaatccggatcatcttgctgaaaaaggggttgctgattcccttgattaaaacagcgatagcctttgaatccgtgcgctttaagttgcgggcgctgttattcggaatataattatgttccttaaccacctgcatgatcatattctttgtctccggattaatgtccggatgattgttaatggcacgtgacaccgtacttacgcccactccgcagattctggctacgtctttaatattaatcgattccataagaaatacacatcccctgtcatcctctgccgtaaagctttgccatcttccggcaccttaccgcaatctcatctgttatttccccgggaaccatgcgccatctccagtttcctcctagtgtggatggcgtattaatccgcgcttcccctccaagccccagatagtcctggaccggaatcaccgccagctttgccacgcttgacagcgcaagacgcacgaaatcccagtggatttcctctacaggcgtatgcggattgttcatataatccacggaaagctgtctgtcttcttcccccatctccccataccatcccctgatggtattattatcatgggttccagtgtaaaccacacagttcgaagtgtaattatggggcagataatcgctttcctcccttgaatcaaatgcaaattccagcaccttcattcccgggaatcctgtatcttttactaattctagcacagatggtgtcaaaaatccaaggtcttccgcaataatattaagttttccaaacttttcctgcattttccggaaaatatccatgcccgggccttttttccaggttccgctgaccgccgtgctgcttcccgctggtatggaatagtattcgtcaaagccgcggaaatggtccacgcgcaccacatcgtacatgcaaaagctatattccatgcgccgcatccaccattcatatccagtctccctatgatactcccagagatacagcggattgccccacagctgtcctgtggccgaaaaaccgtcgggagggcagcctgccaccgccaccggattcctgtcctcatccagctggaacagctccggatggtaccatgtgtcggcgctgtccagtgccacatagatggggatatccccgatgatacggattccattttcattggcataggacttaagcgcgctccactgttcttcaaatttcatctggaggaacgcataaaatccggtttcatccgccagttcatgccggagcacctccatggccccctgcttctggaggcggatatccttatcccacaatgtccaggtcctgcccttatagcggttcttaaccgccatataaaaacagtactccaccgtctcaggccaaagtcttcctttggcctctgccgccgtatgtcccttctccttccaccgtccataggccctgcggagtaatggaaaacggtttaaatacaatttcccataatcaatcgccctgggattgtcaccgaaatcggcagaggtacactctgcttctgttaagagaccttcttccaccagtctgtccagattgataaagtacggattgcccgcgaaagctgaaaatgactgatatggggaatccccgtagctggttggccccaaaggcagaatctgccagtaatgctgccccgccttctttaatatatcaataaacccatatgcctctttagaaaacgctccaatcccgtacctggacggcagactggcaaccggaagcaacataccacattcccgcatcgtgtccctcctttaattatgtctgaattttccgtatatgcctatccctttaccgcacctgcagccacacccttgatgatgtatttctggcagctcagataaaaaataatgattggcacaattgccaggaccagcatggccatcatggctcccatgtcaatggaaccgtaaccgcccttaaggttctggataaccatgggtatggtgcctttttcctggggaaggatcaggctgggaagcagatagtcattccatatccacatggcatttaagattgcaaccgtgacagcagtcggccggagcatcggaaataccacatgaaaataagtctggacaggagaacagccgtcaatcatggccgcctcttcaatctccagcggtattgccttcacaaacccgcaaaacaggaataccgcctgccctgctccgaatcccagatacagaagtacaagtccatagatggaattcagatataagtcattggccgtcttggacatggtgaacatgaccatctggaacggcactatcatggcaaatacgaaaacatagtagagaatactataaaactttgttttaaccctggtgatataccatgcggtcatggaggtaaacaggacgattaccgccacggaacagaccgtgatgaacagggaacgcccaaacgccatgaaaaatcccgtcttcctcacgccttcaaaatagtttccaagacccacataggcttctgccatcgggaaccggaacggggcgtcactgatataaagcttactcttaaaagcattcatgaaaaccaggagtatgggaaacaggaatgcaagggaaagtacggaaaaaaatatcgtcatcatcatgcctgtgaacctgctgacctccatctgctggtcatctgtatttttatccttcctgcccatcagttttccacctccttacgccttgttatataaagctgtgtcagggcaatgaccgccaccatgatgaaaaatacaactgccttggcctggcccacgccttcccaacccaccctgccgtaaaatgtactgtagatgtccaacgccagcatactggtctgccttcccggccctcccgccgtcagggccaggttctggtcaaacagcttaaaggaattggtcagggttaagaaaagacagattgtaaaggacggcatcaccatggggattgtaatccggcgcagtgtctgtgtcttcgtggccccgtcaatcttagccgcctcaatcagctcaggcgggacattctgaagcccggcaatatagatgatcatcatatatccaatcagctgccagttcatcaaaataacaaggccccagaagccatatttggcgtcaaaggacagggtgaccccgaaccgggccaggatgccgtttaacaggagctgccagatatagcccaggacaattccgccgatcaggttgggcatgaagaatacggtacggaacagattcgtccccttgattcctcttgtcagggcataggccatcaaaaacccaaacacattgatcgtaacaacggatacaatggtgaacttcacggtaaacaacagggcgtttataaagttctggtccaaaaatatctttctataattacttatgcccacccacgcagcgtcccgtaccgtggtaaattctgtgaatgacagatagataccgatgataaacggatacaggaatgcaatgataaacgcaatcagcgttggcagcacaaaaatcggaaaataccgtttcattgatttttgcatggcgcaccctccttaaaaatcacatgatgatcctcatccctcaggtaaaggccctcaggcaacgaaatgggtgaggaagattccttacgctcacccatgtcaagtccggtccttaaaatcttatttggtcatggccttttcacttgcccagcctgccttcatgtcatccacaaccgcctgccattctttcccgccctgtacatactgtaacagggatgctccaaagtcatccttaaaggtctggcttgggaaggaagtgaaattccaggatacagaatacagatcgccattacccatgtatctgtcaacttctttggccagtgggtcggatggcttctcatcagctgtaaaagtgtcaaatggcgcgatgaaacctaacttatttgttatatagtccttacctgtctcagaactgaacagccatgttaagaagtcaagggacgcctgctggtcctcggccttggcctggctgttgatggaaaagaagttctcggtaccgatacataaaccctgcttgtcttcgccggacattccggtgtaaattggaaggaatttcacatcttctgcttttacagtgttgccttcaacgccggctacctggctccatccccagttgccgttctgtaccatggcaaccttgcccagtgcgaattcagccatggaatcctctacggtcttagcgcctaccatcttcgggtccgtgcaggaattattcaaatataaatcgaaaatgttcttaaaattatcggaatacctaaagtcgatagcatccttgtcactcacaccgtcatctttatattcataataaaccggaaggtttgcaagatgggtctgccatctccagtcctcgccgggcgcaaaggatgtggaagcgaacacgccgtcaattcccagatctgctttccttgcctgcatatcctcggaaacagcctttaatgtatcaaagtcatggatttcatccatggatgctgccttagcgccgtccagggcaaaatacttctgcatgattgcgtcattataaataatcccgtagccctctaccacataggggatgccgtacacgccgtcaccatcggtcaccgccatggtcttatctaccaggtggccgtagatttccgtatcacttaaatcgaggcagtacttagcccatgacttatagccaatgggtccgttaatctggaacagtgtggggggttccttcttcgccacttcagacttcagggtctgctcatacgtcccggccgccgcggtctggaccttcatcggtaccccggtctcagccgtgtacttctcagccagttctacccatacatctgcaacctcaggtttaaagttcaggtagtaaatctgtccctttccttcggccgataccggttcccctgactgcgtcccctcccccgcttctcctgcaggagattgtacggttcctgaaggtttggaagaacacccggccagtgtgcctgccgccatagctgctgccagtgaaagtgctgccagtttcctcagtttcataatgatatcctccttccgtatccacgttctctgccgcggacactttccatgctgtgttacctttatacaatgttctcagaaaccttcccggtaacgatatcggtaacgtttccaataaccttggatttaatatagcacaatacatgtaatgtatcaagtatttttttattaccatttatatttttgttgttatatcacaattttcccttacattattatgcaaatcccacaaatccaatcggcttgttgtctcccggaccaccagctttacaggaagcaggatttcccttccttccccggctgtattcctgccttccaccatatccgccagcatttccactgccagggctgccttgcgtttcatatcctgccgtaccgtagtcagcccaggacttaataaggatgcgtacgggatatcgtcaaagcctgcgattccaaggtcccgggctatcctaaggccctgggacgtaaagtatcccagggcttccagggcatacaggtccgacaggcagaacagggccggtcttagtcccgcctttatgttagccttcacaggctgcacaagggcttccaatgtttccctgcgcttcttacggtccatgcccaaagatacgaacctcacctggccgctgtccgccttaccctcctccttaccgtccttcttaccccgctcctttttaccggcctggcatcccagatacctcacatggtccaccccatggtcccttcctgcgcacacataaacaggaccgtatccgcatgcaagcagatattcggtcatgagttttcccccttgccagtcatcaaggccgacgttgggcacatttccccggcaaccacagccatcgatggagaccaccgggcgttttagaaggcccgcaatcttgtcacagtcattcttatggaagctcagggttatgaccccttccacctcctgttccatgaccatcctgaaaatgtcatccatgtcggaggacgagtagaacatcatataatatcctttttccctgagacactgctctgccatgcctatgattttcccatagaagggatcggcgccaatggcatcctcataaaccttgtggggattcgccaccaatgcgaccaggcgggaacctttttgtgttcccgccgccttttctcctccctgggcataccccatggccaggatcagctcctggacacggcgtatggtgccgggggaaacccgcttcgtcttcccgtgtatgacattggataccgtggccgtactgacccctgccagttctgccagttcccttatggtaacgccgtggctgtcctgtttctccatatctccccaagcgcctccctgtcccaggttttcatatcttccccgccttcatttccatatcatgcctccagtatatagatcctggactgataatccccgttggtcccgtcgtacttctccttattgtccccggatgaggaatcggataccataaggccgtaattcatcagctcgtcgccgtacacgtccatttccttaaatcccccgtgatatccgccgccctgtatggatacgtgatacatcatcccttcctccaggccggacaggcggattttccggtatccttcatttaccggctccaatatccggtaatatcctatcagggcctttttgcggtccccggataccaccatccaggcagtcacgttgccccttccgtcaaacgggcttatcagcctgatgaatgtaccggactggatcagttcccggttctccttcatgaaggcaatctgcagccttatcttctccagttcctcaccgttcagctgattcaggtccagttcatatccaaaggtcccaaagtacgccacattcgccctggtttcaagaggcgtggtgcgcaggacctggtggttgggtacggccgacacatgggtgcccatgctgctcaaaggatagaccatggatgtgccgtattggattttcagccgttccactgcatccgtgtcatcggatgtccagcactggggcgcatagtaaagcatcccgggatcgaaccttgcccctccgctggcacaggattcaaagaggatttggggatatcggccaatcagcttctcatacaggctgtaaacccccagtatataccggtggaatacctttccctgttcctccggccgggcgcagtgggaatagacctccgacatacaccggttcatatcccatttgatataggaaaccggggcttcgtccagcacccttatcagcatctggtaaatatgatccaccacttcttccctggaaaaatccagcacaaactggttcctgccgtggcaggcgctgcgtcccggcgcggacagcatccagtcaggatgggccttgtaaagatcactgtccttgttcaccatctccggctcaatccacagaccgaacttaagtcccatggcctctatcctgcgggcgattccggctaccccgtccggcagctttgcctggttgggataccagtcccccagcgaggacctgctgtcgtccctgtggccgaaccagccgtcatccaggacgaacagctccacccccacatccttggcggtcctggccagtcttaggattttttcttcatcaaaatcaaaatacgttgcttcccagttattaatcagtatgggccttgccttatcccgccatggtcccctggccaggcggctccggtaaagcctgtggtaggtctggctcataccgttcagtccttcaccggaatacaccatcaccacctccggtgtctggaattcctccccttttttcatgggccacgaaaaacaatggggatggatgcccagcatgatcctggtgacctcataggtgtccacctctgcctgggccaggaaattgccgctgtacaccaggctgaagccgtaaacttcccctgaacactctcctgcatccggccgtttcaatgcaaggaagggattataattgttgctgctacatcccctcatgctgtatattgactggattccgtgttccagcctcctggtcttcacactccgctccctggcccaggccccggtcagctccaccatctcaaacccactgtccggaaggtccacgctggcgctcatggcctggtttaagaccactccttcctcattatcacaaatgaacctggcgctccttgtgatgacgggaaggtcctcataaatggtatatgtaaggaccagctttgtccttatccatgcgtccccaaggacaatctccagggtggacgcctcttttggatcttcggcgtaagctgcgggaagccccttaagcccaggctttccctgataaatccggtggctttcatagacaaattccgtgatatggcttccatccgtctgaaggatatcatacgccggggcacgcatgtccccgtgtccataggacgggtattcctgcttgatgtgctccatggaaaactccctgtcgccttcgtaaaagcagggggccatggaacggatccgtatctccagcatgtgtccgaacgattcccggtccctgatggccttcccatagtacaggtgtcccagctgcccgttgcgcaggattgtcatgatatagcttaccttatggttatacaggtggaattcctttccatccccatgtactttaattggcatatcttttacctcccaaggattatatgtctaatccttttcttcaatgatgattctcctgaacagttcatagagcagggaaagttcataggaattcatcctgatcctgtacttctgctccatttccttgaaaacctccctggatatcccataaaaccgattttcctggggggacagtccgcgcgtctgttcctgcaccgggtccgtggtcataagccgctcaatcatgaacgcaatgtgcatatacaggttcagcctgacatgcccggtcatttccaggtgataatactgctcgtacttcatgaggaccagttccacctcgttgatgaccaccgtggggtttaagaaccggaggcggctgacaatcccttctatggaaaaaaaccggatgtactcccgtttcagctcctcgaattcctccctggtaatcagtcccttaaaggacccccaaagctggtcctcccccttgccgtccaggatgtcgtagatattcagccagggcaccccaacatgttccggcagtgccgaagtggtgagtatgagcagggtctgcttaaaatactccctggggttctcatccagcagcctgcgcagttcctggtaatccattgtcacgatgtcaatcagggactggtcgatgaccttgcacatggcctcctgaagcttttccgctatgcctacgccggacatgcaggacacgatgatgttcctgcccctggatatcccctcaaaatactggatttcaaaggcatatgtctccctggcagccttcacgatatccaggaaggagcaccgccccagcatcttgatacccacatccagggcaatggccgtggtcacattgttgatgatcagcagatctcccgccaaatcgttcttgatggaggaatacagctggctgagggaaccggtgtccaccagaaggatcatccccttcctcgcattgacccgttccaggtactgcctgacctttgctatggtatcctccaccgccgtctccatgggcatgtcgatggcctcaaacacaaaggtgcggcaggtccggttggcaaccttctggatactgctggccgtggaatccccatgggcaacaatcagtccatggaattccatggtttccaccatatattcgtggagggacagggcaaacaggaaatcaagggcgcctcccgtttcctggtccatctcataaagcctgctgcagatctgtcccgccacatagtatgccttgggcatggcctgctcaaaataggcatccagtttcctgaataagtcttcccccggactactggatctgaataagccgtgcaggaaccccaactcttccaggacaatctttacctcccccacgccgtaggaacagaggatttcacggcagattggaacaaacaggttccaatccggctcccccctgtaaccggcgtgttcccgggccttcagtttcttcaccatgcgtttgaaattaaggtatacgctgtccaccgaaggttccatccgttcaaaggggattccggaaatatcttcccacagcgcctttatctccctccccgtcccctcctcaggcagctctgcctggtcaaagggcagcccctccccgtccaccaggatggaaggcaggccgtaatattgtgacagctggctgcggcagtctgcctcaggcagttccctcatggtaatatgcagtatatcgcttcccccctgcctgtaaaatgcattggcacagctgacctgtatcaggttctccagctttccgatgttcccctgcagccgcgtgagcatcagggcctgcgccacctctccctccacctcgatccggcgccccaccttcctggcttccttctgataaaagagatacagcatctgaagccgttcctttaaggggcggtccatcatgctggggatgggaacatgaagggtgatacgcctgcggaaggtttccagcaggacttcatccgggttttccgtggtggcgaaaatgaaacgcaccctggaggatttccacatattgtcgcccaaagggcggtactgtcctgaatccatgaacaggaacagtttttcctggttctcaaaggacagcctgtggacctcatccaggaacagatagcctccgtccgcctcttttaaaagtccgtcccggtccttgtctgccccggtaaaactccccttcttatatcccagcaatgtggctgagagaagttccgggttattggcatagtccgcacagtttaagaccacgaagggggcgttggcttcaatgaccccctggctcagggcatatgcatggatcaggcgggcaatgaaactttttcccaccccgctctcaccggtaaggagcatgggcagaccatccggcggataattgacggccgccatacacatttccacggtctgcttctggcttcccgcatatccaaccatggatgagaacacggagcagggcctggcggcatctgaattgtcatgcatggcaggccgcgcggcggcatccggattaccgtacatggcaggccgcgcggcggcatctgagtacccgcccggggcagcggcctggtctggcttcgtccctgcattcccccacacgtcctccccgaaaaattccagatcctccgaggtcacggggaaccagtacaccggccgtgtactggtttttaccgcaagcccgtcctccatgagccttgtaagataatggctcaccacctggcggctcaggttcagtttgtctgccagatctgccgccgttatcttccggttgccgctgcatgattcctttagcgcttcatagacccgttcttttgcctgcatggataagatcctccctcatacctgatttccatttctcctcttccctcaacgggacagatccgttcttttaccttaccatcatcataccatggggatttgttatcatgcaattacaaaaccatgcggttcctaaactacgcggtttcaaaactacgcgattcccaatgcggagagcacgatgcccaggacaatcacccccacaatcagcacattgatgctcatcttcttttttgtcagaagatagaagcataaaagggtaaggcataacgggaccaggcccacgaacagctggtccagcatgttctggagggagaatatttccgttccttccatggacaatgaaagcttactgttaaataccaccatgctgctggccataccgcctaccatcatgagtcccatgatactggccgccttggtgaggacggtaatcaggccgccgctgtacagcttctcaatatattcagaacccaggctgtatcccaaaaacgtgccatagtagcgcaccacgttgcttgggatgttgaataacagcaggaacacgaggggggccagcacattgcctgcctgggccatgctgatggctatgcccgcgcagatgaccctccacacaccccagaatatggaatcaccgatacctgccagcggtcccatgaggctggtcttaatcgggttgatggaacccgcatcaaaatccttattctcgctgttctccttctccattgcgccgcagagtcccatgatgaaggtggacatgggaaccgtggtattgaaataggaaatatgccttgccatggcctccttcttaccttccggatcatccttataaaaccggttgatgaagggaatcatggaatagcagaacccggaggccccctgtttcgccggggtcacggatgtatataaggtaaaggaacgaaggaatacggacctgagcatcttcttttcttctctggaaacatcggttatcttagacattgaaaaaatcctcctcttcttcatctaacatcccctctgcagggacagtggcaggtgcagcggcttttacccttataagctggttaagttccagatccctctgcgccaccagcagggctgctatgacccccagggctgcaagggcaatcaggggcagcttcagataggccaccagcacgaatcccaggaagaagtaaacgcagattttatggttccacagaagctttagaagcatggccatacctacggcaggaagcaggttcccgcacaccgtaagaccgttcatgatgacagccgggattgccttgaccgcagcttccactgccttggagccgaaaaggattgcaaagaatggaatcaggcagtacagcccccagttcagacaccacaagccatagtggagtcttgtaagttttttgtcctccccattctcagccagcttatcaaatacaggcgcaaaccagccaatgatgccgatccagataatatttttcgcctgctgtcccagcattccgatgggaagggccagcgggagggcaacctcagggcctcctccgctcatgatggcaaatgcgcagcccaccacgcttgcgattccgcactctgctgcggatgcgcctcctatatttacgattcccatgaacacggcttccagggatgcgccgatgagaagtccctgctgtatatccccgaacagccaccctatgatagggcagatgaatacgggacggtccagcatggtgaatcccagcaggtccctgacaccggatgcgataagtaccatgactgcaatcacaaatgcagtaacaagtatggatgaatgtgctaacatgaatgaatcccctttctttctatgatttacaatacttctgaaacaagcttcttttcatcggaaggaaccatctgtagggctgtatccggagccagctccaccagttcccttaaggcttccatctcgtcggccgtcaggcttaccgaccgggaaatgatggtgcgctccgtaccgtcgccgctggtgaaccgtcctgcattgccgatgttcacatattcgataccaggtacggccttataaatttccagggcattcctcaccgtccttaccaataccagtatcctcataccctcagaccttggattgttaagcaaggcaatgatttccggcattgtcttgatgatgcatttgatgccgtccggcacagccattttaagcgtcatcttctgcatctcattggcggctgcctcgtcatcagcaaccatgatgccctgtatccccaaatcccttgtccatgccatggccacctgtccatggatcaatctctcatctacccttaaagccttaaccataatctctctcctctctcattatgggcttctggcgtccctgtcttagacgccgccctgcggtaaacgccactgtttacccaaagaaatcctcatcctgtccttcctggttgaccagttccacaagctccatctgattcctggaatcctcgatatactgtttaatcccgtccttcgtgattccttccggcgcaatggccagggccaccagcagcggcaggttaaaacctgcgactaaaaatacattttccctgactgcatatggcacgattttctggttcacgcttccgcccttgatatccgtgagcacaatcacctgatcctccggccggatctgggcgaaataccgttccagtgtctccaccagattctcatcctgatccacataagcgttgatgcaggtaatatttcctacattccccataaggaagcggaccgtgctctccgccccggaagcaaaggtcccgtgggtggctatcaaaatcttcttcatattggaactccttcccttttctgtttgattttcatttcacttatatattaagcaaatacggtgccaactttttttagacacttaaaatacgctggaattgccttgatttcatagtcatataaaaattttaccataccaccccgtaacgtgtctaattaaagtgtccaatacttgtgtccaaaatgtctgtttaaaatcctgctgcgggacagatggaattggacacaaaaaaagccagcagtccaaagctgctggccgggaacaatccgttcccaatttacgactccactataaaggcttcatatggctgcatcatgccatcctccaagatttgcggcctgttttggatgaccgccctgcagccgggatacaggataccgtccagccgcccggccggaaccggccggtccgtcaggttcgctgccaccagccatctcctccccctgtattcccgttcatacacaaacagggattcatcctccggaagtaacaggcggtagcttccttctgtaaggatttcctcctggtggcggagccggatcagcttctgataataatagaacacggaatcctggtctttaagggcttcctccacattgatttccttataacgcggattcaccttgaaccacggggtgccggaggtgaatcctgcattctccccatctgtccactgcatcggggtcctggcattgtccctgctcttattccatactgccttctgaaattcctccctgcttatggtcttttcacgttccaccagctccaggagggcatttttcacttccacgtcctcatactcctccagctggtatgaggcattgaccattccgatttcctccccctggtacacatagggggtgcccttcatcccgtgaaggattgtggcataggccttggcgcattcctttctgtagcaggtatcattgccccagcgggaaatcaccctgggctggtcgtggttttccagatagagggcattccatccatgtccctccagcttttcctgccagtccgacatgacccgttttaaatcccggacatcaaatggtttcaatgcccacttgcggttcacatggcccgggatccggtcaatgttcatatgttcaaatgtaaaaatcatattcagttccttccgtcccgggtccacgaacagacgggcattctccgaagtggagccaggcgcctcccccacggtcatgcagtcataacctgccagcgcttccctgttcatttcctgaaggtactcatgaagcctcggtccattggaatgcatgaacccggtataataacgcctgcctggctcttccgggtaatccgggaaatccgtatacttggaaatggaggcaatcacatccatgcgccagccgtccacgcccttatccatccagaatttcataaggtcatagacctccctgcgcacggtctcattctcccagttaaggtcaggctgcttcttatcataaaaatgcaggtaatactgcccccgtgtcccgtcataggtccaggcactgccgcagaagctggaaccccagttattcggctcccctcccccgtcctttggatccttccagatataataaccgctgtaaggattatcccctgatttcctgctttccacaaaccacctatgttcatccgaggtatggttggcaaccaggtccatgacaatcttaagtccccggtcatgggccttttgaatcagttcatccatatcctccatggtgccgaatttcccatacatcttccggtaatcccggatatcatagccattatcctgctggggtgaatcatagacagggctgagccatatgacatcaattcccagttccttcagatagtccagcttttggatgattccctggagatccccgaagccatccccgttggaatccttgaaacttctgggataaatctggtacacaacggacttcttccaccaatcgcccatatacatatctcctcttcttaattaaatttcctgaaagcgcctgaatccgccttcatgtcctgatgggattatatacagataccgcgtccgtggtcaacaggttacgcccataacctccttattgcacaaacagcgcggccgcgcagtaaaccagaaggaccgccatcataaggttgaccccctttgcatgcctggcaagatatttacaaaacgccgaaccgcacagcgcccacacaaaggagccggacgcgccgataagcgccagcaggatggtgaatccaatgattgccccggtggaatgatacactggaaggatataaagcgtcatggccgtaaccgcataaatataaatcttcggattggcaaactgcagtatcatcccggataggaagctggcctccttactgctgtccgcacttggattgaccgggctttttaagaccttccatgcaaggtaaagcatatacgccgccccgaaaaactgcatggttaactttaatctgggcagaagggtgtacagcgttgtgctgcaaaccgtacagaccgtcatgacaacggaaaacccggccagtataccaagattgaatcggaagctgcggcgaaagccaagccgtgccgcattgctcatggataataaattgttagcgcctggggtgtacgctgtaataaaacagtaaatcaggaaatcggataaatgaaacatttgtgccctcctctttacaagtcctgtcataaattatataatagtacaaaatgactattatattgtacttgtacgatataataatacatcttgttcgttatattgtcaataagaaggaggaacgtttgatggattccatgaatttgattgtcgctaaaaatatacggagactgcgtgaagaaaataagctgagtatggacgaactgtcaaagttaagcggtgtcagcaaaagtatgcttgcacagattgaacggggggagggaaatccaaccatttcaaccctttggaaactctcaaatggcatgaaggtgcctttcgacgctttaaccgtccgcccgaaaagtccttatgagattgtggatacggcagaattacagccgctgcttgaagatggcgggaaggttaaaaactattccatcttcccggatgatgagaaccgcaggtttgcagtctattatctggaattggatgagggaagtttctgggaatcagagccgcacctgaaaggcaccactgaattcatcacaatatctgcaggccgtattgaaatcagcgccgatggacaccggttcacggtggggaagggcgaaagcatacggtttaaggctgactgtgtccattcttacaggaacacagggcatgaaaccgcaatcctgcatatgattttgtataatccgtaaaaggcaggaatggatttcaccacacccaccagaccccaccctaaaaagcgcccatccagcagatcctgcagcgtccatatggtaaatctgcactatatataccgaggaaaattttgtaaatttttcacaattacacagaccgggaaattttgatatattagatactgcaatatggctgtagcttctgtcgtgaaggtcattcacggaggctgcagcctttttatgtctgcaaaaaaagaaaatcaaagaaaatcaaacggaggtttttatgaatcaggattcaaaccattacatggcagaagaacccataggaaggctgatgctcaggttttccatcccctgcatcatgtccctgctggtatctgccctttacaacatcgtggaccagatcttcattggccgcggcgttggatttctgggaaatggagccaccaatgtggtatttcccgtgacaatcatcgcccttgccctgtcccttctggtgggtgacggatgcgccgccttcttaagcatctgccagggacggatggacggggagcaggcgcacaagagcgtgggaaatgccgtcggtatcatcaccgcgtccgccatcctgctgaccctggtatttgcagtgttccgcgaccgcatcctggtgggcttcggcgcaaccgccaataatatggggtatgccagggagtatttctcctgcctgatcatcggtattccatttttcatgtttaccaactccatgaattccatcatccgtgccgacggcagccctcagtttgccatgggttccaccctaatcggatgtttcatcaacgtaatccttgaccccatagccatattcgtgctgggctggggcatgaagggcgcggcgctggctaccatcacaggacagattgtgtctgcccttctggcagtatactacctggccagggcaaaatccttccgcctgaaaaagagcagcttcataccggataccgctatactgaagcatatcctgccccttgggatcagcagcttcctgacgcagatatccattgtggtcatcatggccgtaatgaacaatgtactggtcatctacggcgcacagtccaaatatggggctgacatcccgctgaccgtggtggggattgtcatgaaggtatttcagatcgtgatatccattgtggtcgggattgcggccggctcccagcccatcgtgggatataattacggcgccgggcactggcacagggtaaaatccatcttcaggaccatgatgatggccgagttctgcgtgggactcatatccatgatatgctttgaggccttcccactacagatcatcaacctattcggcagtgaggacgggctgtacaatgagtttgcagtgctggccttccgcattttcctgggagggatcgtgctctgctgcatccagaaatcctgcagcattttcctgcagtccatcggaaggcccacgctgtccatgatgctgtccctgttcagggactttatcttaagcgtccccttaacattaatcctgcccaggttgtccggcgtaaccatgaccctgtattccgggccaatcgcagacgtggtttcctttggggcggctgtcctgttcatgtaccggattctcagggaactggaccggctggaggacagcgcaggggaaccggcagatatccagggaaacatccgatcccttgaaaaggccgggtgctgaaaaaccggcggttaaggaactatctgctaaaaagccaggcgatgaaaattcagcggataataaaccagccaatattcccatcattaccgtctccgcctgtcaaaacgccttccaggatccctttcgtcctcataccggccgcgtccaaaaccattgccaagggggccatccccatggaaatgctccctgcggctgtggccgcggcttaatatataatcatgcatttccttcatcctgccaaatgtatagtcagaaggatgctccggatccatatgccttatgatttcgtcttccaggcgttccaaaaaacctttgaactgcttctgctcctgatcatcaaagcagtcaaacaggcggtccgtgtccctgccgtcaaacccatccgcctgttctaccgccctgcggccctcttccgtcagtatgatattcatactccgtctgtcatgttcacttggcacgcgcttcacatagcccttgttctccagctttcttaatagttcgctcatggactgggtactgattccaagaagataggacagttccctgtggcttatctccggcttcagctttaagattgccaggatccggccctggcctttaaatgggcttcccatggggccattttccttgtaagcctctgtctggtagcggtgtaagagcattccgatatgaaagaagtgttcggacaggttttttccattgtccttctgctcctggcctataccctggtccctatcacagtctgcgtcacagtatgacccccgctccccatcatagcctgcatcctggcccattttgggttccatgccatgttcctttttgagttccgtgccatgttccattttgacttccatgccatgttccttttttggttctatgtcatgttcctttttgacttccatgccatgttccttttttggttccatgccatactccatgtcctgcttcctgctctcatcttcatttcccttacttatattgccctcgctcatatttccctcattcatattgccctcgctcatatttccttcattcatatttccttcattcatatttccttcattcatataacccacatccaactcctttcattctgccgcctgttccatgattcccctgatacctattatggattcagggcttaaataatgctctatcctgcatgcgtcatgctccgcgacctcttccgggactccgatgctgcacaggaaccgtttaaatgtttcataggaatcgttgattttagacgcaattgcataaccatcttccgtcaggtcaacctcatggttttcatgtaccttaatcaggttctccgatgccagtttacggaacgcaatggaaacgcttggttttttgacgtccagtgccgatgccacatcaatggcccgcacatgcccattcttatttttcaaatacaatatggcctttagataattctcttttgaaaccgtgatgttcatgactcacccttcttatattccagctaccccagaatctgttccatactcaacgaaaaaacgggactcagcccaagcgccctcagttctccttcaatgccgtccatacatccattgacctcctcctgggaacaggatggatttaccgtgatctgcagcgacacaatcctgcgctccggcccgtaatcgtggaaatcaatctgctttaatgtcacaagttccttccttgcgtcaaaaaccgcctgaatctgggactgctgctgtccggatatcccctcgcccagaagcagtgtgaagtgactgatgaatgactggaatccatccttcatgaccagcacactgatcatgattcccacaatccagtccgcagaaagaccggtcagggaataaagggccgcagaaccaatggtcagcatggtcatcttgatgtccgctgcctcattctgctcacaggcagccagggccatggaatccagctcacggttcacatgtctggtatacgccgacataccgcacttgaccaggatggacaggagggataccccatagaccagaaggggcaatgagcggtcccgcgggtgccggatccagtgtatggattcccggaacatggaaactcctgccaggataatggtcatggaaataatgaggccaaggacatattccaccctgccatggccataaggatgaaggctgtcccccttgcgcccggacatcctgaatcccagcaataccagcagggagtttaatgcatccatcaggttatcatacccttccgccaggacagccacattcccgcacgtgattccggccgtatacttacaggcaaaaagcaggaggttgccggccgcggacaatatccccaccctggcgccaaggttttccctggacatgggctgtgtcagtgtttgttccatatataccactcctctccgggccggcatgggccagccatatggacgattttacggataccccggtatccgtacacgcaaattacatcaggtacctgatataaatatagcaggtacctgatgtattgtcaacccggagtttaaaatcagttcaccggcccagacagatcacgaatcgaccgtataaccattcttccctttctgtttggtgcggtaaagcgcctggtccgccttttcatacagtatgtcaaagtcccggtcttcttccgaagccaccgatatcccgatgcttgcggacattttccatgtctttccatccctggtgcattccgtgtccagggcatgtgagagttccgccgccttcttcctgacccagtccgcgcccggaatgggaatgaatgccacaaactcatccccgccaatccgtcccagcacatcaccctcccggaaatgttcccgtatgatcctggtgaattcccgtatgcagtaatccccaaatgcatggccaaagcagtcattggcctgtttgaaattatcaatatcaaagatgaagaatgcgtatgccttttcaggctcctctgtcagcagcgcagtcaccttgcgcttggtggcggccttggtcaggaaccgtgtcatctcatcaatataagccagaagctcctttttcttttcctcatcaatattcttacggtaggtaaacatgtgcaggcagttatcctcatgggaaaagaagatatacgcgtcaatgcgcatccagaaataaccgctgccgtcctgggttatcatgaaatcgtatttcaggtggctgtttccattttcatattcccggattacattctcaggagtgaaggtagagatgtaaccctgcctgaattccttcttaatctgcttctgcgctatgacccgcagcgcctggtcatagggcagcccctgggcacccaggctttcaaagtactgggccgtgcgctggtttcccgtacagttcctagtaatgttcagttcgtagatattgtcgtagagctgttccgttgcctgctggaatgcattttcccgctcctccataagctttgtgatctgcttgttaaaattgcgtatgaccgtggtgatgatgaacagcacaatggaaatgatgacagcaatgccaaggatggtctggtacaggcggtcccgtatcacatggaccgtatcctcgctgtcctggtctatgacaaggtgccaggacagatccggtatgtatcttgtgaccacgaaactcttcccctggtccagggagttgtcggtccagaatccaagattctccgtatcctctttaaatcccatgatttcatcccgtatcccctcctgcccgtgaacctcaaaccagtctgtcttactgtaacccgtatatgtggtggatacctcaattataccgtcctcattgaccaggcatatgttcatgttgtatttgtcctcatagccctcaaggaattctttcaggtagctgatgcggattcccacccctacaattcccagtatattcccggagctgtccgccaccttacagttcacgaataccgtgatggcatcatccgaaccatccacctcatcgttatccacattcatggaatatccaaggccgctgtccatcaggtcaaaataccatccattctccggatcatcctcagccagcaccctgtctatgccgttgaaattgtaataccgcctggtcgctgacgataccaggaaaacagaatcaaacccgtatttatcccggtaggttttaaggtaggtctgaagcctttggacatattccccattctcaaggttttctgtctcacaggacagctgctccaccaggaggctgtcatgggccattgtcagcgaaatgttgaccggctttgtcagaagggtcgtaagctggtaatgaatcccctcccctgtcagcgatgcaacctgttcaatattattaagagtggcctggtaattggccctgtaactgaaaaacgcggtcatggaaaatcctacaatcaggacgatactgatcagcaggtttgttttgattaattgattattcttcacagctgttgtctccattctcataccgttattcaccccgtgccctcctatataggccaccctatataagacattcaatatgtgccatcctgccagggaaggatggtccattgcataataaaaagccgccagaggatttaattgctctgtgcagcttttgaaattcatatggttgcaggtcacaccatcgtccctattcttattatacacgacttttctgtttgtggaatccgtttattaaaagaatatgaaaggaatatcaggttccggaaattcttatgccctgatttccgccttaccttttctccaatagtatggtaaaatcttatataatccgagaaaatcagggcctaatttacagcagatttcatacgatagggggatgtgacattgataaatgagaatgaactgcagcaggtcatctacaacgtactgctgatgcagatccggtttggcgcgtaccgttacggggcacgcctgcccacgctggaagaagccagccagctgttccttgtgtccattgacacggtccgtgccgcctatctgagcctgaaacaggagggctatatcagtctgtccagaagcgtgggggcttctgtcagggtattatacacatctgaggagatagaacagcacatacaggcattttatgccctcaggaaagatgggctgattgacgtaagccgctccatgcggcccctgttcagccatgcacagtgcattggctttcaaaacgcctcaccggaaacattggataaaatccaggcgctttcctctgacagccgccttcttccttcccatgccatgatccggatcctgcaacacatttatggttccctggataacgacctgctgatgcgccttgtatggaggatattcatgttcttccaggcgcccttcctcagtatagaccagaacataaaacacttcgaggaagaagccaatccactctttaacatgattaggctctgccgcaacaaggagtgggaaaggctgaggattgcggtggaggattttcaggaacagctttccacggccctgattggtttttgtgacaagcgtatcatgatgtcccctgccggcaagcagattgaattccattggtacagctatgagaaggcttcccagctccgttactcccttggcatggaaatcctgatttccgtcaaccgcggcctctatccggtcggctccttccttccctcgctggataagctttcaaaggaaaaacatgtttccgtcagcacggtacgccgtaccctgaacctgctcaacagcatcggcgtaacaaagtccatcaatgggctgggaaccaggatcctctcgcaggaggaaattgctgataattgcgatttaacccagcccgttgcgcgcaggcgcctgctggattgtgcgcagggtctccaggccatcgccctctcctgtaaggatgtggctgaactgaccgctgcttcccttgacagcgaggcaatatgccagttttggcagcatctggatttattgaaacaaacggacagatatgaactgactgcattttccatcctcaagttcttcatccatcacgcccccttccacgcagtcaggacagcatacgcagaactgttccagcagctgatgtgggggcatccgctgcgcggtatgcgcatggaatcagagtacctgaaggcattctacctgccctatctggatttctttgcaggttgtgcgaaaaggtctgattttaccgggttcccggataagctggaggagcttatcctgtttgaatttaagtcaatgcttggaaaacttgaagtcctggggattccggaagcctccaacctgcttttttagacagggcttccggcaactggtccgtctgccgtttcacaacgcttcagccaaaccctgttctctgaaacctattggcctggggattcccaaaacgggaaaacagttggaaaatataaggcgggattgcatgcctaatggagccgcctccattccctgggcgtcattccggtctcattcttaaatacactgctgaaatattttgcatcattatatcccactgccacggcaacctcatatattttgccggcaggattctttaacagctccttggccctgttgatacggcatcccacaatatactcagtcaggttctcccctgtctcctttttaaacagggtggacaggtacgcaggatgtacaaatgccacttcggccagcatggccagcgatatattggtgtccaggttctgtaggatgaaatccttgaccagacgtaccgtgtcacatacactctgtcccgcacatccatacacggccttttgggataaatccctgtaaaaaagccgcaggtcttctttgttacgggatggcccttctgcatgcatcctctgccctgcccccgtatattctgccagcaggcggattccctcctgcaggttcccttgcccggacgcgcccagaagtacgtacagcctgtccctgataactgccgtcacaatcctgaaccggccctgggcttttaatttcctgattcctgattccatctcgtggcccgtatctccggccggcccggctggaaataatatcagtgcaaattccccagacagttccagcttatcccaataatactccctggcctcatccgatagcgcctcatatcctgtcaggtagctgtaaaggcatccgtccctggccagttccatctgttcataagccagattcagtatatcctttatcttaaccgcgctgacgggtttgagcacgtaatccagcacggaaaaacggattgcctggcgggcataggaaaaatcagcataaccgcttacaatcacaatcatccttcccttccggtccagctgggacagcatctggaatccattcatccccggcattttaatatctgtaaaaatcaaatcatagtaagaatccctgcatagttcaagtgccttctgaccgcattccgcagcagacacctctgcgtccggtctgagatatctgaccagcatcagaagtccttcccttgttttcaattcatcttccacaattaatatcctcatgccggtacctgccctgtatttattctgattgtgacaagggtatggtccccttccacactttctatggtgagtccgcttccttccccataccggtatctcaggcggttatggacattggcaatccccagatggaaatcctgctcatctgcaatctgaccgctgccgttcatcctgtccctcagcagccccagggttttcctgtcaatccccttcccgtcatcccagaccgttatctcaatcccatccggaacagggactccccgtatcctcagcatgccgtctttcccatcctcaagaccgtgggatactgcattctccaccaggggctgtaaaatcatcttggggacctgttcctcagcaattgccccatccagatacacatgatatgaaaaccggtctgaaaaccggctttgctgtacaataagataattctccacctgctcaaactcttcccgtaccgtcacggtggattttgtatcatctatgctgtatcttaggatggaggatagggatacaagaagctggctgctctcaaagtcgcctttctttaaaaggttccagttcacacagtccagggcattgtaaagaaaatgtgggcttatctgggactgcatggcccgtatcttggcattccgttcgctgattgtaagcctcagcgtcctgttgaccagtatatccatttccccggccatgctgtggaaagcatgggataaatccgcaatctcgtcatttccctttatggttgacatatcactgaaatcgcctttcctgattcttttaatatcctctgccagcagttccattccttctgtgtaacggtatgatatgatgtaggagaagctgactgccagaatcatcatgatcagtgaggaacgcacaagtagctctgaccagaatctgtctttttccagcaccccttcttttggtacacccacaaccgcggtgacagccccgccaaatgccccagcaccggcaaatacccggctgctgtcccgggccctccgctgctccagtactttgtccaggctgtcttttgtacgtataagttcaattgtccctttctccaggcccagatattgtatcagttcttccggatccaggtccagataaaccgtccccgcccttcctgttacggacactgtcaggccatctcccccatctgaggccttactgcccggcaccgcccatgcgtccctgacccacaaaagctccttcactgaccgcagcgcttcctcggccgtggaccggtccacgcttgtcccggtctgcgcctcaaccagcttaaggtttgaactgattttatcttccagcagttcctccgccatgtggagatggttttctggctggaccgctataagtacaaaccagttgaacaggattggcagcgcactgaccagcagaaacaatatcagcagtttattcctcattgtatttacaattttcaacgcgttcctcctccattccgtatctgctgtttcatgcctgctattttgtatctgtccagctgttttacctgcccttcttaagcgccagtccgattcccgctgctgccattaacatagaaaccacgggattaacaagattcagcaatgcaaaccgcccatattccaaagcgctgacccccagggcaccatatatgaatgcgctggcagcggtccatggaatgaggggcgtggacatggttgccccttcctcgattgtcctggaaagcacggcacggtccagccctctctcatcatatgcctctttgtatatatttccattgagtacaatggtcaggtatgtatccccaaaaacagcatttcccagaatactggtcagcatggtgactgctatgagggagaaatggttcttaagccgccctgtaacccgtttaaggatgacatgcaggaacctggatttctgcaggattcctccaaggcacagcgccatgaaccccagcaggaaagtcggcagcatgctgttgattcctcccctgtttaccagaaggttcacttcctcggagattgtctcaacatatcccccatccatgatggcccttaaggccccggaaaccgtatttccctggaccgccacactgcatacgcacccggccccaatcacaaggataagggacaggaccgcatggatcctggcaatacagaggatgaccagcagtattgcgggaaggaatacccagatgttgattacaaactcctgctggagtatatcccttatctggccaatctgtgctgtatccagcacagcgttcctggcatatttccggttcagcaggaagaacaggaccaggctcaccccataggacggaagggtggtctttgccattgaacggatgtgacggtatacatcggtgccggaagatgctgctgtgagtacggtggagtcggatatgggagacattttatcaccaaaccaggatccggccacaatggcgccggctgtcaccgccgccgggacagatatgccgcttcccatggaaacccccatgatagcaacccccactgtccccaccgtcccccaggaagtccccagtaccagtgacaccaggctgcatattaaaaaggaggacaggaggaaataacggggtgtcaggatgccaagaccatagtataccagggctggcactgtccctgcctggatccagaccccgatgatggccccaatgagcagaaagaacaggagacctataaatgcctgggaacatccctccctcatcccatctaaggaatcctccatggtcattcctgagcatgtcccaacagctgcaataaatatgatgctcaggatcaacagcacaatgatatcagtcttaagcagaagtgtccctgtgaaaagtatgcatagtattccaaggacacctaataaagagatttttatatcagggagcttcacatcaccccatcctttcattttcagcagtttcttttttcgtccccctgacaatatccagaaccacgaggacgattcctgcaagtatgaataatacgcctgttaaccggcgggggctaagatgcagccccgtctttcccatatccagggccatcacaagcacaggccctataatcagcacaaggctggaaggaatcgggccgatttctttaatcccctttgcatttaatacaaagcagatgaatgtgcagcatatgatcagatatgccagacagaccagctgcccgccgtctatctgcccaaattggttgtcctctatgatcatccatgggagaaggatgattccggtcagccagaactgaccgcggatcaggttccctatcctgtaatactccagcagttttgtcaacaggacacagtatatgacccagactaccatggctgacatcatgacggcatacccggttttcaccaggcttggggaggactggaattccatcagcagcacggccccgatgcccgccattccgatatagatgctggttaaaggttttatcttgctgcccagcagcaggcttgcgataatcatggtaagaaggctctggaacgaagaaaacatgatggactctgtctcattcaggcttaaactggctatattagacaggacataatgaagggggatcatggctgccgtcaccagatacaggcaccggtcctctttccttatctttgttttggaatgtaaagggacgcacaggaccgtcatcagacaggccgctcctaaaaagcggatacacaccaaagataccggccctgtaaaagacaggacatcctttgtaaccgcgaaacttggcgcccaaaataacgataccaccatcatgcccagtaaagccttaatccgtctgtccataaccattcctttcatctcccgcatcttagccacattataacacatccggttccgtaagggcaaggaacggcacagagcgtgcctaaagccactggtcctcaatgccgttcctgtataaatagcaatgtatctgacgcttttacgccttctttcctgattccttgtaaatggcaattcctgcaaatgcacagataattgaaataagcggtgccagatagcagaggattgcatagggcaggtacgaaagtgtagccactcccagggtaccggccatgaaagcgccgcaggtggtccatggcacaagggggcctgacagggtggcaccttcttctatggtccttgacagcacggcagggtccaccttcttatccttatatatatcacggtataaagagccgttaatgatgatggacaggtatacctccgccatggccatacagcccacgattccggtaaggtaggtggatatcacaaggcagcccacatttttaatttttcctgcaaaggttcccaccaatgttttcagatatcctaccttttccaatatcccggaaagcatcagggcaatgaatgccagggagaatgtccacatcattccctgtatgcctccccggttgaccagggtatccaccatggcgttgccggtatccatgctgattccgctgttaagcaggttgacaaactcagtaacggatactccctgccatatgacggcaatggctccccctgtaaatactcccagcaaaagtgcgggtatggatgggaatttaattgcacttaataccagtaccagcaccacgggtacaagtgtcacagggctgatggtaaaactgcttttaagggttgacaggatttcattggtagttgcggcgtcatatgcgttattatatccatgtcccatgactgccagtatgatggttgtcatggccaaagccggtatcacggttaatgccatggattttacatggcggtataaatcaatctgtgcggactgggaagccagtatggttgtatcggacatgggtgaaagataatcgccaaacgctgctccggaaaccaccatgcctgcaattaaaggggccggcactcccatgcctgaacccattcccaacaatgcaataccgatggttcccgccgtcccccatgaagttcccgtgacaaatgcggttgcacagcaggccaggaacccaaggggaaggaacaggccaggcgttatgaaattcaaaccgtaataaatcagggtaggcaccgtgcccgcagcaatccaggatgcaaccagcatgcctatgataataaagaataacagcgataccgaggcatttttaaggcttacggccatggcatcaaacaactcgtccatggtatagccaagggtcatggatattgcaaaggtccccagcacacagagtaccagaaggctgatgacatccatcttaaaaaccgcgatgcctacggacagcagtaacaggattcccaggaataccccggccgaaagcccgatgcccggctgtctcttttctatattctttttccccgttggtttcttattctccattgttttcctcacctctcctcgtatttttcaattgatacctggactgatttcatcagcgggaacccgctgattgggtcaaatgtgtcatcatgggtaatattgttcacattatgcttcttccacccatgggtaatctgcactaccccttccccaatctcatccccttccattatccttgcccgtaccgtcatatgtccgatggacgaagccacctttaccatgtcgccatcctgcagatgaagccttgccgcgtctttttcgtttatttccatttcagcttctgttagggccgatgccagggccggtatattgtggttccttccatggtaatacatgactttccttgcacctgtcacaagggtgaagggacgcgccgggtccgtggtatttgattttggaggtatgtactccgccagttcctggtatccatattccttgagtatttccgatgtgaattcaaatttccctgttcttgtattaaaaggcttttcctggttttcttttcttattttatgcttttcataaactttttgcgcatactggtatccggagggattacttctcagcacatccatggacaccccgctgtccgagataagccattcattcagctggtcctcgtccttccatgggaaatattcccctgctccaagcctcaccgcaagttcgcggaacatggtatattcatcggttattcccggatccggtccaatcatccggttggtcagggtaattgtctggtaaccgccgtggacatgaagttcgctgcgctccagatatgaggccgctggaagtatgtaatccgcaagctgggctgtctccgacaggaacaggtcatgaaccaccagaagttccagggcgcttaaggcttttctgaccttgctgctgtttggattggtcatggccggattggctccggtcaggaccatggccttgaaaggatacggttttccggtcagtatctggtccatcagggtcatggtatgacattcctggcggtaatggtacaggattgggaaccggccgcgtcccacgggattcagttccagaaggggtttctcgttgtacagtaccagttccttcatcggaaatcccactggagagtaattggcgcccttctggtccactgccccaatcaggccgtccagataggcgcaggcccgtatattgttgattccattctcgtggtgctccagtccattgcccacatagaccactgtgtggggcatgctttcctttatctttaaggcggtttccctgattaaggtttctgcatcgcagcctgtttcccgtgccacatactcatacgtgaatctgcccgcatattcctttacctgatcaaagcccacggtaaaatcccggatgaattcatggtcaatccagccgttctgaatcagttcccgcataagcccccaggcaaatgcaccatcgcttccaggtttcacctgaacgaacaggtccgcctgccttgcaatcgggctgtatcttgggtcgattacaataagggaagcgcctttctcccttgcccggttaatctgctgggtcatgttgggatgggcgtggggcggattggctccccatatgatgatgcagcgtgaattttcaaaatccggctgggcattccagcgtccgtacacaagggaatatcctatccaccgccctgcaaaacaggctgaatcattggaaaaataattgggtgagccaattgcatggatgaagcgtctggcaagttcctcctcctgtgcgaatccgaccgcctcccctttccatacgcctacggactgggggccataggtcccttgtattgtcctgattttcccggcaatttcatccatggcctgttcaaggggtatttccacaaacccctgccctgttctcttaagtggtttccttatgcggtcaggcgcgtaaaccatatcagttccatggctgcccttgatacagagcctgcccctgttccacacatgctccttatttccttcgattttaactaccttcccatcctccatccagcagtcaatgccgcagtggtcatcgcacatcctgcacaggctttttactattttcttctcgctcatgtccatttcctccaatcaaagccctttgaccatatccgccagcttgcgtccaacggactgctgcttcctgtcattgcattcatccgggtcttcataattcagcgcgccgccgatacagtgcttcacacattcagggtcacctgcgcacaggtcgcattttctgctcaccaatttttcatggtcaaaatgaatgtttccatacggacatgccagcatgcacatcttgcatcccgcgcaccgctcttcccttatctccactgcccctgtccgtgcattcctgctgattgcatgggccggacatacctccatgcaccatgcctcctcacagtggaaacaggtcatgggcatcacaaaccgctgcgatgcatatacgctgacccgtatgttggaatggacgcgcatgcagtcacttcctgtgctggcaaatgcacatgccatctcgcagttcctgcagcccacacatttctttaaatcaactgtaactgtcttcatctgtattcactccccttttctaaagtttccttgatgcaaatgcccgcatattcacgtattgctccagatattccacaacacagtcaactttttccccgcctttgattaatggcctgagcttgcccagcacggttactgcatcactgctgcccacaagacaggcgccgcagatttttccgtccttatagcagacctttaagtatccctttccctccgtttcatcaaaataggccgcgtcatcaattacatcgtcattgaattttccaatggatgccacagttgtatcgtacatctgggtcacgttcatattaaggcttccctcgtactccagctgctttccggccatggtgcgcccggctgtcttccccatctccacagccgtgggccacagggcatggattacatgttcctccccaaacgtggttgggccggccgccacatcgcctgccgcgtagatatcaggtatattggtcctcatgtacctgtccacaggaatcccccgcccgacagccaccccacttccctccaaaaacgcggtgttaggcctgacccctgtgccgattatcataaagtcagccggaatcggctccataccctttacatgtaccaggaaacttccgtcttccagatgctcgatttcctgtgtgcttgcgcctgtatatagggctacccccttcccccttatcttttcagtcagtatccctgctcctgtttcatccagcacggatggcatgatgcggtccataagttcaatcacggtcacctccaggcccaggaacctggctgcccatgcggcctggagggctacaaatccgcttccaaccacgaccgttctcttatactgcctgaaatatggcatcagcttatcagcatcctctctggtccacatgttgcagatccgttcatcccgtattcccggaataggcggcatcacggcaaatgaaccagtggcaatcagcagccggtcatagccgtattccaccccatctgcggttatcacaaccttcctgccggaatccaccgaaaccacttccgctgtaatacattcagtgtccagcccgcaaaaataatcaccatccctgatttccatccctttatagggcagctttccccgaaggacatagggaagcaggacccgggaataaggcatggacccttcctttgaaatcatcaccacatggctgttcctgtcccatctgcggaattcctcaagcgctgacaaaccggcagcgctgtttccaatgattactatttccatctggcatctcctttctgtctggtttgatttccaaccttcctacctgcactatattaaaagaatgttaataattaaatatttaacattcttttaacaaatattttctaccttattctttaaatactcttcctttttccatccatggcccaatctgttccggctgtttgggacataaaaagtccgggacaaccatcccggaccgtttcatgtattcctatttgattttaatatgtaaatccctctgcctcagccagccgcctgcccgtttccttccgccttactggcagatcctctcctgatgccgcttcagctgctccaggctcctgatacagtaatatccgttaatctgttcaatcagggccatctccttcagctccttgattgccctgacggccgtaacccggttgattcctaacaggttggatagaagctgctggctgattttctccttaatcaggatcttgccgtcatagggtactccgtagtgctctgcgaatataagaagaaggtcgcatatcttccaggccgcattatggaaattcgtatgccgtatctgctccatggaggaaaggaacttggtggacagggattccatgatatccatggataactgggggtccctggcaatcccctccaaaagcatgtcctttgtaatcagtatcagctcagacggaaggaccgtcttaaaattaaccggggattcctggtcaaagagaaggttcccctccagaaggatggagttgctttcattaaaattgtaaatccgctcctcccctgttatggtggtctcaaaggcagccaccctgcccttcttgacaatgtagcagtagcccggctttgttccggcctggaccagcatatggttctttggaaatacctttctctgtcccagcttctcaagcctggaaattccccttggaagatacagcagacgcgagacaaaattcgcatgcggcatctgtacggcagcgcccgattcctgattcacaaaaatccccctccctcaatatgaacttttaccagccttaccagcacatgcccgggaatccatccccgcccggacatgccctgaaacgcccccaacgttccccttaactcttaacaagattataacactgttatgtttttaacgaccagtagtatatactacattatagcagatttttacacttgttgaaagtgataagattgtagtattgccaacttccctgaatccggttattatgatataagtaggtatattgggaggggtcttaatttgaaaacagtgattatattaggcgcaggacagttcgggcgtgccgtgtccaggctgctgaatacagaacagatggatttgattgcattcggggacaacaatcctgcccttcaccatatgggtgaggaggacaggatcaggatgggattcccgccccgcgtccccatcctcccggtggaccaggcggtcaccatgtccccagactgtatccttacaggcatcaccgatggatgcaggaccaggcagctgaaggagcaggccctgtcccttggtttccgcggggagttcctccttctcgaggagctttaccgctgctttgatatacgcagcgctaccttaaagcagatggccagacggttacatcagcaggacattcccgggcagattgccgaacttggcgtctataagggtgatacggcctggaaactcaatgccctgttcccggacaggaggctgtacctgtttgacacctttgagggattcgattcaagggatatacaaaaagaagaggaatatggatgttcctttgcaaagaaaggggatttttccgatacaagtgaggcagcggtcttaaaccggctgccgtttcccggacgcgcggtgatacgtaaggggtatttcccggaaaccgcgtccgggctggatcatgaaacctatgccctggtaagcctggacgcagacctttacgcgccgcttctggcgggcctccaatacttttatcccagactttcccccggaggcatgatactgatgcatgattataacaatgagcggttccagggcgcggcacaggcggtggctgattatgaaaaggatgatcagcggctttccctggtcccgttgtgcgacctgcatggcagcgctgtaatcatgaagcctgcggtatagggaaaaagggggcgtaccacatgaataaccaggatttcagacagcatttcatcaatacctgtgagctgctgggcataaaggattaccagcaccgcatttataccgtacgtcctgtcatggagccgggtaagacctactcttcttccgatgatttgatgcgcctcctctttctccccaggcagaggacctgtacctttaaccaggtcctgcacctgttcacgtggaaagaggggttttatccagtctggataaaggcagcctgcagcgggaacgagatcacgctggataccagcctgcgcataagaaaagccggggccatggacgacggccggttctatccttttatcacctgatatacaccaggtccacaatatgctcattggagtgggacttgtcccagccatccttttttttcatctccaggatggccttatctgtaaatgaaccttccacgcaccggatctgggggtaatactccttcgtctccaccacatgggtgaatccgaaattgctctccagcttcttaaccagcgcgccctcctccagttcttccacactttcaggcacttcaatatactccaggtccacacatccgttaaccgcgtatttcccaatgcgcttcagcccctggggcagtttcagcccggtcagttttttattctggtaaaaggcctgggcgccgattccaaccgttccctccggcacctcaatcctgccttcacagtttcttccgctctttacaaccccattttcaatcactagtccggattgcgtggttccggtaaataatccttccatatgcatacctcactttccaacttccatcctcctgccgcagcaggctgcaaagagggattttccaaaaaagcggaaaaatccctcttttaaatcctattttacagatacgcgcctaatctcagctcctggccttcaggattgcatttctcatcaggtccttcatcatgaacagcttatattcattctttcccatgggccgcgcatccctgacagccagttctgccgcagcttccgccacctcttccgttatggtccttcctttgaggaattcctccacatgggtcatacggtatggcacgggagccacgccgccgtataccagcctgacgccctggatgacatcatccgttacatccaggcaggaggccagggagacaatggcaaaatcaatggcatcccttacacgcttcttgtcataatgcatccggccctttaaccgtggcacacggatttcctttatcagctcacctgggttcaggatgtcctggaccgtcagttccctggtcagcagttcctccgcagacagggtgcgctccgtggtaacgatctcagcctctgccatcaccagcacagggcttatatcggacggggaaacagcgtaacagccgcagttcatgcagcgcccagcctctgccatggcagtcccgcggtcaaaggaggcagcatcctcttttaccaggctccgctcctccaggggaagctcctgcagcttgttggatatccctgtccccacggatttgggatcaaagtggaggaatggattactgccggttcctgcaccactgcaccgtgaacggctgccttcctcactgccgcacggtaccccgccgcacgccgggccgtcctcctcagaaccgcccaaatcccggttcatccctgcggcggcaacacggcccgcctgaatggcccggatggcaatatccggccccgtgacagcgtcccctccggcatagattccttccttctttgtcttaaaggactccgtatccgcatcaatcagtcctctggcggattggagctgttccccgaaccgctctcccaagaaacttaaatccaccctctgtcctgttgccaggatgatggtgtccgcatccatgaccatccggtcttcctcgtcatatacgggtgagaaacggtgctcaccgttaaacacggacaggcatttcttagcttccaggccagtcaccttcccgctgccgtccgtcacgatgcggcccagtccccagccgttataaagctttacgccctcttcttttgccctggcaatctcttctgaagcagctggcatttcatgttcctgttccaggcataccagtttcacctcttctgcccccagacgtgaggcagtcagggccacgtccatggccacattgcctccgccgcacaccagcacctggctgcccatggatttctccagatatgtattgacctccaccaggaagttaaggccgaactgggtcaggttctccccctcaagtcccagcaccggctgtttccacgcgccggtccccatataaaggctgtcggattcctgctgtatctcttccaccgtgatatccttccccacgcagacacccagccggaactccacgcccatatgcgcaagggcatccacataggcgtccacaatatcctttggcaggcggtaatgggggattccgtagcgcagcacccctcctgccttttccatgcggtcgtatacaaccaccctgtgtccggctttcctcagataataggccgcagccagtccgccgggacccgcgccgatgatggccgccttcctgccgctctccttttccggcgcggtatagtattcctctgcgtgctccaggatataatcgcccagggaccgctccacaccatggacattgacgctgtccccgtaggtacactggttgcagtcatcctggcacaggtgggggcagatgcgtgaggtcatcattggcatgggattatagcgcaggatgatcctggccgccccgtcccagtcccctaccctgagcctttccatgtaccccggcacatccgtccctgccgggcatgaccttgcacacggcgaaccgtggcagtccatgccgccgaacacggaatggtaacggttctcaccgttaatggcataacaggtctttcctcccttgcgcttacagtccagggccttccccacggaatccggataacggtaataccagcaccgcacatcctggcagatgttgccgccaatggtcccaatggagcggatcaggggtgatgcaacggaatacgccgcctccgcaagggccggacatgcctcttttacagcctgttcctcagcaatccggttcagcctgcagccagccccgatcttaaggcagtcctcctgcgcttcaaggacgtcaacccccggaatcttcttcaggttgattacggtttcaggatatgtctttaagataccgtctttatagacgcccagcaggtccgagcctccggccatggcctgggccgcgccctttgaatcttttaacatcctgcccgcttcctcgaagctggcagcatttacatgattaaactgtttcatggtccattccccctctattcaatctttcccatggcttttaacacaacggccggcgtggtgggatactccttcacttccgcaccgatggcattggacacagccatcaggatggctgagggtgcgggcgaaccgctgatttcaccgaatcccagtgcatggaaggattccgtatcaaactggctctccagtatcacggtgtcaaagggcgggaactcattgaaggtgcgccatttataatcaatcatattaccgctgacaaaccgtcccagctttttatccatgaccatctcttcaaacagggccgtgtcagcccctgcagcgccaaaggagccttctgcctgcatccgcacattgaccgggtcaatgatctggcccacatccgttccctccagggcgcggagcagcctgacctcccctgtctcaaggtttacctccacttctgcaaaatacagggcgaagttgggcttgtcaaagttctgctggtaaagccccattccggtgatggtcatctcaggtgtgccggtaatggcaatccagggaaggcgcatctgcggattcttcttcgggaataccaggaagtcctccgtatccagttcttccgcatccatgtgcagcttctcagatgccagcgtaagaagcttctttttggcatcattggcagcccggaccgcacaggtgcccatggtgatggttcccctggaaccgatcatgcctgcatcgtatcccgtcccatgggtatcggagttcaccagctggacgccgtcaaagggaaccttcatgacctccgccaccattttctggatggcatggcgctgggcgcctcctgtttcaccgatacacatttccacggtcacgctcccaaagggatggagctttacaaacccttccgtggggtcttcgccgatgtccgcgttgccgtgtacacccacgcccacgccgatggcccgctttccgtcctcactgacccaggttgggacctcccagcccttccatttgtccttccagccaaagctggccgcggattcctcaaatgcagccgtaaagtccacggagcgcacttcccaccacttatagtcacgccagatataggagtccccggcttttacgaaattcttcttaaatacctcatagggatccatcccggctgcccggattgccgtgcagacaaggggaatcagcgcgcctttcaactcctgcccgccaaatccccgtatgggcgcctgggagctgtggttggtggcaatcagcatggtatccaggtcccagttcttacatttgccgcagaatgcctgggcctcccccagccccacggccgtcatggcctgggcgtaagtggaggacatgccggaatcaatgtaccacatgccctggatggaattgatgatgccgtcctgcgtgattcccaccttgccgcggatacggctgccctgacgcagttcataggacagcatgtggtccgtgcggtccatcatcagcttcacggcccggcccgtctcgcgggccagggcgatggcctggagggccagatggggaatcagctgcttgcttccgtaggaaccgccggagtggcatgcaatcacgcgcaccgccacgccgggtatggatgcctctgtgttgaacttctggagatggggcgcgccgccgttgtaataaagggtcactgcgctggggctggtccactgggcaatcacgcccggtgattccggcggcagcggatggggcagcttgtcgtagcagtagtatccttccgctacgtatgctgcttcctcaaaccctttttccacgtcccccacatgaatctgattaaaaggctcctcggaaaaaggcgttaccttgggcagaacattgcccggaaattcatcataaagctgaggcgcaccaggcttgatggcctcctcgcagtccagcacaaagggcagttccacatactccacttcaatcagcctgcatgcctcgtccgctgcctccagtgtctcagccgccaccagtgccacactgtccccggtaaagcggacacgccggtccaggacccgtctgtgctgcggcagcccgcatttccagtcaggggcgtccttataggtcagtactgccttgactccgggcagggcttttgctttctccacgttgatatccgcaatatctgcgtggggataaggacttctcaataccctggcaatgagcattcccggaatccgcacatcgtctatgaactggcggcggccggatatcagatccctgccgtccgcccgtgttacatgttttcctatgtatctgtaattgctgccgcccatactatacctccccctttgccctgatgtccttcatccgtccaatggcgtcctcaatggcaatcatgacctgataatggctgatgcacctgcagtaattgcctgacagggcttcctttatgtcctccctggttgggtccggctttttgtcaagcagggccttggccgacatgacgattcccggcgtgcagaacccgcactgaaatgccgaattgtccacaaaggccttctgcaggatgctcaattcccctgttgcctggtcttccagcccctcgatggtggtcaccgcagccccgtcacagtcagcggtcaggatcatgcaggacgcaaccgggtcgccatttaagataaccgtacaattgccgcaggccccgtggtcgcatcctatcttggtccccgtcaggtccagcctgtccctgagggtatggaccagcgtctcggacggcttcacacagccctctgcgtcaccgatgatgaatgtccgcattaccccattaatctgaattgaaactttgtccattgttacctcctgtatcttttatttccggacgtaccctccggcattttcccctgttaccgtcatgccggaccttcctgtggcgccggattgcatataccgtgctggttccatcataccatccggcaccggaattattaagtatgccaggccacagatggaatcccggcaacaaatgtaatctggcatcaggtgtaacctgtactacttgttcttttccactgtcccgtctacactattgttaaatagatgacaaaggggtgcgggctatatgaaaacagttgtaattcttagcgccgacagtctggggatggctgttgcggaaatgctgaatccgatggaaatgaagctggtgggcctgggggatttaagggctgaagcctggaacgtgttctctgatttggaaaaaggggaactgaaggaagaaatcgagggcatgcctgtgatgcccgttgacctggccgtggggcttcagccggacatccttgtcatagccaccacggatgcggagagaagccatgcactggaatacatggctatccgggccggattcctcaacgacattgtattcataagggatatccatgagcagttctccatccgctgcagcgtcctgcgccgcctgtgccgccgtcttgacggcctgggagtggagggaaatgtggcggagctgggatgttacaggggggatacctcctggcagctcaatgccctgatgccggaacgcaggctttacctgttcgacacctttgagggctttgatcccagggacgtggcaaaggagctggaactgggatgttccgaagcagaacccggccgttttgggggtgcggatgaaaagaagcttctggaacgcatgcccttcccggacaatgtaaccgtcaaaaaaggatggttcccggaaactgcgtttgatatggaggaagagacatttgcccttgtctatatggatgcctgtctctataaccccaccctgtccgggctggaattcttctttccccgcatggggaggggaggcgtgatcctgctgacaggatgtgatgacatgaaataccgcggcgttgcaaaggccgtggaggatctggaaacaaagtacggcgccctgctgatgctgcctgtgggtgacctggaaggcacggtcataatcgtgcgcccttgattgcatataccaatgattacatataccaatatggggcatccgctgtccatgcaggacagctgcatcggtccggccgtcaccagaatggaaataaccggcacaagccacggctgcaaaacaaaagttcctgcgttctcctggttttaaagccgccggcttgtggatgggaaagggctgtatccggcccgccgccgcagggcatggaaacatgccgcataaaaaagcgccttgtatgtattggggaatacgtaaaagcgccttggggggagggatgaaaaggtaacgttttcggggctgtaagtataggaccggtatcttccgcgccgcagaagcacatgcgggcaggtaccggtcatccaaccctggttgtaaagaaattgattggcatgtacccatgttcatgccaggctttgtatcaaagaccagaaaggacaaattatatgaacttttacaaaaatcattttggtatgattatttcgtctgttgtagccatatgcatctccttaatcatggcaacctctgccatctttgttgacaaacttacgttcacggtgcctttgcttgtgaagaactggggaaccgcctttcttgtgatttcgctgacaggcatgatattcccgctgaccgactggtcctttgcccttggaaggaagctggggctgaagccggaaaccctgccccatgtgcttctggagaattttgtggccaccctgttttttaacaccaccgcaaccattgtccttaccgcggtaaacgtgtttaacaatccggagatagaaggggctgtggcagccggattcctgccaagcacctccgctgtgtttgtaaacggcgtgattcatgactggcccatcatgttcgtcataagctacatatttgcattctttgtgaccaaggccgccattaagattgcaaaatcatcggtgggtgaattaaaatcaccccattcacctcagaaccagttctgatgcatgccctggaataggatccgcaggtttgtattgttccggggttttgaatatgtatacagcgaaaagccgtgacgattccaggtcacggcttttcaatgcatgcatttggggataaacaatgcaacggccattatttacccaaaagccatcgcagaagtccagcgcattaaagtacatcatatattgaggtttacaatacccgggaaatcaggttatatgctgtaaccgcataaagcaggaccgtcattacaccaagacagaccgcctccccttttgaacctttatcataactttcttttgcattcactatcattgacaatcccaaaaatacaaacattattggcatggaaatatcaaatgacaccagcctcagcaaaccaaccgcagcaaaaagtatcgttaatactgaaaatatggccttccacttacgcatctcttttcctcctggcagtatatgttatcttaattgtaaaataaccggattaggaaagatagtatctgaatccttaatatttactgcattcctgttgatggttgatggattctattgtattctgtatttaacaaaccggaacagcctccggagatgcctcataaaataaaacggttaaggagaaattaaatatgccatttgcggaaacatgtatctatcaggttaagccccagaaggtggatgaatttgaatcattgatgctggaaatccaggattttctaaagaaacaggagggattactcctgctacggctggttaagagaggataccatatagacctggaacagatcagggaaggtctgcctcccaaagaaatcacccgcatcatcaaaagcgtcaagtatgtgctttactgggaatttgatacaaaggaaagttatggaattgcccagaaaaatctttatgacagccactggaagtccattgagagatgcctggtaatgccccatgataagtacttgggtgaagtattattctgacagcaggatttaatccaacgctgcccaattacgtttacatggcgccttgcggctcatttccaccgtaacagcatccgtacccgcagaatgtcccatataaaggatttccaggtaaatgcaaaagaccttcagccgtaaacaaaacagccgaaggtcttttcccttccccctgcctggggaaaaatatgatttaccattattcagcgttcacgctcccactggcccttgctgttgcggccaaatgcactcccgccccctgcctccacatacccaagtatgtcaggatacaggttgcatacggtattcagggaccagatggatgcatgtccgggattatttacatattcatcggtctcatcgcctgcaaaaaaacgccagcccgtatccggccacttgtcgctggtatcctcatcccggtacatatatccgatggcccttccctcttcaatctgctttgacacaatgcagccgccgttatggggaagcagctggacccattccctctcatccggcacataccaggcattcctgtaccacgccccgccttcttccagaagatggcgtacaaggtttgcattgatgtccaggaaggacagcatatcctcctcattgttttccgggacaaaataaacagccccgcagatacagcttatggcatattccttgaaactgtggtaaaacacctgcgccttggctatctgataatcgaatatcccaaaaaactcctcttccgttatcatgccgcacgcaaatgccttccgccccagtccaatccgctcattgatatcccatgcatagaatccccgttcctccaggtagggacggaacatggaggcacggtcaatccgctcttcaaaggccatcctgccctcttcccccagctccttaaggtcaaacagcggcgcgccgcaccagaaggtcatgaactgctcatactccttgcccgatgtatactgcttcatgcaggcctcctccaggctttccctgtcatggatgccgtaaagccggaacaggtgggccttcagttcctctgcatccttatcatcctgacacctgtagagattttcatatcccatgtgtaccgggattcccggcgccttacggcatgtggcgatgccgcttaagagcagggcaaattccttcctgtccgtgacccggggctgctgcggttcaggcattgcctgtatttccgttaagacggccctgagggcttgtgctatcttatccatctgactgcctcctgtatttgatagggacagtataacatatacatgcatttacatccagatggaaatcctttatcccatcacggccttccccgcatacccgcattcccctgtaatcccctggtaccggcaggtgctgcactccgtgatataccccacatacttatcggtttcaatataagccccgcacaggccctgatggcgggcatatacctgaaggcacatatccgctacaaaattacaggcagtggctttgccgctacagtatttacagacataatccccacaggccctttcctctgcctccataccgtttggaagacgcattttctttaactgacggcccatatgccatggcctcctttccattgatgacgccgggttgcctccggccctatgactaagcgctgcccggcttaaatccgccgcccggcgcccggtatctgaaagaaggcggcaaggagccgccttcctggttatttatctggtttcttatctggttgcttatggaagccggctacttggaattcctgtcatccttcatgccatggagcgctctccagatatgctccggatccagaggcagttccgtgaagtatacgccggttgccatattaaccgcgttggcaatggccggagccaccggagccgcagagccttcgccagcttcctttgcgcccagggggccttcctcatccggtgcaaagtcgtagaaagtacgcatcttaggcatgtcaagggcggttggcagacggtagtcgcggaagttggggttcagtatcttaccttccttggtcacattgtgctcatagaccgcatatccaaggcccatcccgatggagccttctaactgtccttccacagccctcttattcagggcgcggccgcagtcatgggcgaacacgaattcatcaatatccagcacgcctgtctcctcatccacggtcagatgggctgccccggtggagaagctgtaggccggcgcatagttggtggtgttatttccattgtactgggagttgtcggtgcggtgataataggagcccacgccaatcagctcatccccgcccttgacggtcatgtacttgaacatggcatccccaatgggcatctggaattctgcgttctccttgctgattacctttccgtccaggcactctaaggtttcaggcatgacgccccacatgggggcaatgacctcaaacagctggcgcttggcgtccacggcagcgcggcgggcagcattgcctgccaggaaggtcacgcggcttccgtaagaaccggaatcccagggcgtaaggaaggtgtcggacatgaaggtcttcaccatatccatgggaagccccagttcctcagccacaatggcggtcatgaccgtatcggaaccctggccgatgtcatgggaaccaatgtacagggtggccatgcccctcttgttcatgcgcagggtcacgcaggcagaactctggttgggagcttccagcactgcaaatccggttccggatacaaacccggttcctgcaaagccgatgccctctcccttcttcatcttatcctttttctcataccagccgatttcctttgcagccgtatccagggtttccttgtacgcgcagctggtgattgccaggccagcaggagccacgtagcccgggtcagccgcgctgatcttgcggaattccacaggatccatgcccagctggtccgccgcgaactgcatgttcaggtcatgtgcaaaatgcacctggcaggcagtatatcccctcatggccccggcggacgggttattggtgtacacgcgccttgccaggaaatccacggaattcatcttatacgggaagttggcccacaatgtggactgggcgcacgccgcaacaccggaaccgccgtaagggccgccgtccagcacgtgatagcatttcttggcaaggagcctgccgtccgccccaaaggcagtgtcaatgtgcatgtaaatcggatgacggttacgggtggtctggaatacttcctcacgtgacaggatcatgcgcaccgggcgccctgtcagctccgacatcttggcggcgcagagtccaaaggaataggaatccagcttgccgccgaatccgccgcccaccaggggtttaatcacccgcacctggttctcgcccacgcccaggcagcgcgcataccagaactggtccacaaatgacatctgcgtggacatccagatggtataggtgccgttcctgtaggtggccaccgcgccgtgaggttccattgccgcatggaccatacggtgggtcttataatccctgtgctgcacataggatgcctggtcaaattcctggtcaatatccgttcccgccttcatcacggactgcatgccgatattgtggatgcccttgccctcccagttaacctcgggcgcatcctcttccatggcctcaaaggggtcgaacacaccgggaagcacctcatactccaccttaatcaggtcaacggccctctgggctgtctcctcgtccacagccgccaccgctgcgatgtcatcgcctacctggcgtactttttcagagcacagcacttccttgtccgcgaactcggccgcgaattccccgtttccgacaaaggacttccactcaaaatccctggctgtcagtatgcattttacgcctggaagcttctcagcctcactggtgtcaatagaaatgatcctggcggaggcataagggcttctgaccattttaccggtaagcatgtcagggaacatgatatcgccaacatactggccgtgtcctgtcaccttatcctcagcgtcaatcctgacgtaattgttctcaccggtcaggcggtaaaactccggtttcttaaaataatgtttgtcacagtctttatgcattctctgattcctcctcccagtccatctctgcggcggctgcctggattgcctccacgatcttggcatagccggtacacctgcacaggttgccctcaatggcttccctgatttccagttccgtcggatgcttattcacatccagcagcgccttggctgacatgatcatgcccggggtacagtaaccgcactgcatggcccatttctctatgaactgcttctggattgggtggagcatcccttcctttgcaacgccctccacggtcagcacctcgtggccgtcgcattccactgccagggtacagcaggaattgaccggcttaccgtccagcagcacggtacatgcgccgcattcgccttcctcacaccccttttttgtcccggttaagaacagctggtcgcggaggaaatccagaagtgtcaggttatcttttacaattgcatcaatggggtctccgttgatgattaaatttatgctatgtttcatatccccgtcctcctataaactttccattgcctgtttgatggcacgttttgtaaacacacggatcatatccttccggtattctgctgacgcacggatatcggagataggatgacaggaatccatggcttcctcggatgccttaacaatggtttcatccgtaagggccttgccgataagggcctgttctgccttgggggcgcggatcggggtcgcggcaactgcgcccagggcaatcctggcgtccgtacagatgccgtcttccactttaatcttgactgcaacgccgatgatggccaggtccattgcctttctcaccgcatgctttatgtaggcggcgccctcgttttcagccagcggcgggatgatgatgccggttacgatttcccctggctccagggatgtcttcttgacgcccaggaaaaagtcctggattttgatgacccggtccttgttcgggccctgtaccaggatttttgcgtcctgtgccagcagattgggggcagtgtcacaggatggggatgcattgcagatattccctgccatggtgcccttggtcctgatctgggtggatgcaaccaccttggccgcatgggcaatggccgggttcttctcttttacaagggacgaggtctcaatggtgcgcagggttgtcagcgcgccgatcttcaggccttccttctcatcatattccagatagtccatgtccggaatcttctttaaatcaatgatatactccggcgaaatcaccttatccttcattggcgggatcaggtccgtggcgccggccatgacttttgccgtgctgccaagctcaaggagcagattgcacgcctccccaatggtcttaggagccagatactcaaattgaggtaataccatttacgttttcctccttatatttccttcgttttgcctgttaattgttacgttctccttatgtatctgattgtagaaggaaatgggggaacttgccagaagtgtatatcacagatgttacaattgctacaggtattatttttttacactttcatttccctgtaaaattcaatatagccgcagtccctgcaaacataggcaatagtggggcccagaggtttatccgggtccgggacatggtccagttcatccacccataccagatgggtccggatatggtttatctccatggttccattacatttcggacaattcatcaatttttctcctcctttatgtaacttttttacttgtccagtatacaccaaaaagagagaggcgtgaataccccctctccccatttagctgtatgggttacatatcagtcataacccggtatattatttaaagcccttctttcttctcaatatcctcccgcacgaacatgatgaggaagcttgccagaaggaggatgcagctgagccagatggtcttttcccccataagggatgtggacacgcttcccatcaccgcacccactgcaaatattaggatgaccccataataccgcacgcacctgcccagacattccctgtcctttgtatgacggaatcggtacagctgttccgtggcgctgcgcaggtttccgatgcacatggtggatgcataaggacttcctttaatcttacggaaggcatcgacctgcagtgcacagacaaatgacaccatgatgttggcagccatattcatggactggggcatgaatccaactgcaaacagcagcaggatctcaatggccaccaccatctgcctccagtgaagtctcccatcccgctggtgaagccgcctgatgtgttctgccatatacacacccgctgcaaatgcggcaaccggcccaaaataccgcagggccacgccccactggccggaagccaggtagcttcccatcagcacgatgttgcctgtctgggcattggcaaacacctttccacggcagtaatatgtataagcatcctgaaatccgcctgacagggtcaaaaaaatacccgttgacacagcctctgacatctgtccacgggtatatatatgtttctccatctctcatgccgcctttcccaagttaatgatgatatctttccaactcaagattgtatcacagctgagactaaatgaaaatagcaaattaccagtacagtgcaccggtgtctgcgcatggcagtgatggtgccgcatggcagtaatggtgccgcccagcgtgaatatatcaggcggcactcaatcttattgacagggcagtccggtgtggccctcgatatactccggcacatcctccggataaatatcaagcgcggccgccagttccccgaacaaaagccttcttgcagcctttgccccgtccttttcccggacagacagaatccttcctttgcccttgcgggactgttccattctggatatctccttaatcatggatgccagttccagacagtctcctgactggatagcctccttataggcctggggccgctccctgtcattggcatactccttgcactccacatccggccatgccttaacaaaacgctcggcatccttccggctcatgatgcccctcatcataaccttgtcgctatccaccggaatacagatggtcgtgtctttttcgtatcttggcaccagataataatacagtctgtcattatctgaaaagtctgtcctggagattttctctacctgacatacacctaccgttccatagagtatgaattcaccttttttgaacaatttcccacctttctgaacacattatgttcaagcgtttaccgggtatttatctattatagcacatttttcatattatgtaaacccagcctgtcccactccacggcatacgcatgaatatgagattgcaacggaatacagtgtgcggttaattgacaggagcaggcaaggggaggatgacgacagtttttaggatcagaaggccatgattggggattttagtgtcatatcattctatacaaccatgccaactctgattataataaacaaataaaaacaaaggagtgtgtgacatgccattattactatttatctgtatcattgtactggttgcccttttggtcgtcaaaagcaaacaggcgtcccaaaagaaaaatgctgccaaaatcaaggcaaaggaggagtcgttctgggatatggtccgtaaaaatgtaacaggcatcattccagaaacagccggccttgattttgtactcgccgcaggtaccaaggacgtcaaggcttcgttaaacggatacagacggctgcagacaggttatgatgaactgcccgtttatatcattgcctatggcggggatgagatgtatctcacatccgtaaaatgcccttctgccaggttcatgaatccggatgcttccttcatcctgcacatgacaacccaaaacgtagaaaaaatcgatgcagggaaccgtaaggcagccatttatttaaaaaataaacagtttatcgctatgtctgttgaatcccgcatcatttccggaattgagcagccggaagaaagcaggaaattccatgaatatctaaaggccttcatcgagaaggtgaatcatgattaaaatatagggacgaatggtattactaaaagataaaaatcccatgtcattttgtggactacccgttgtctaaagccgatgggtagttcactgcggctgaaccctccaatcccatcattggattcccacttcagacacacgtccagattgcaatgggaaatttttcccataaccttcctaaccgtcatggccttcacaaccttgttaattggctgaagaaacccagattttccgtatattttgttaaaatccatccggcctccgcgctatttgaaaaactttctcaaataaatggctggacaattcccccgccttcctgtatgatacttttatagttagtcaatactaaccataaattgaaacagtaaagatacctgcagctaaaaaaccatatagcagccacaacaatctgaatcacggacaaggaggatttcacatgagtgttgtcatcatcggaggccatgaccgcatggtaagccagtacaaaaaaatctgcaagaactacaactgcaaagcaaaggtatttacccagatgagcgcaagcctggacaaacagatcggccgtcccgacctgctggtgctgttcaccaacacggtctcacataaaatgatacgctgcgccctggacgaggtggggaatggtacggaaatcgtgcgctgccacaccagcagcggcacagccctcacagaaatcctggaagaaaaatgtgctgtctgtgccgtttgatacatctgccggttgaaaatccattcccggcgtcagtaagctctgagggcagcagcggccagatccacttcctccgctgtgttaaaatgggaaaagctgaatcttacagccccctgttccctggttcccagggcttcatgcatcagaggcgcgcagtgtccgcctgaacgggtataaatcccatgctcctgtgccaggtaatcactgacctcacccgagtcttcatcccccaggttcagggccacgatggcagccctctcctgctgttcaaaatccccatatatacataccccgggaatggcgcttacctggtcatgaaaacggcgcatcaatgccagttccctatcccttatggtcccatcgccctgctccctgatatagagcagcgccgccctgagtccggccagtccgtgggcattgagggtgcctgcctccaatgcagtgggcatggaggcgggatgggttttggagtaggtcatgatgccgcttccgcccgacagcagggggcgcacccggattcctttcctgacgcatatccccccggtcccctgaggccccatcagacccttatgccctgtaaaacacaggatgtctatattatcccgttccatatcaatggaaaacacccccgctgtctgggatgcgtccaccaggaacagggcgcccgcctcccggcaccagcccccaatcctcctgatatccaccagattgccggtgagattagaggcatgggtacataccacggctttggttcccgggataatggcagccttcagggcatcgtaatccaacgcgcccttatgtctttccttttcacttctcccgccctggtccatttccccggtacagccaactaccaccagatccacgccctggcgctccatttcatagaggggccgcagcacgctgttgtgttccagcgccgtggtcaccacccggtcacccggatccagcacaccttttatggcaatattcaggctctccgtggaattagccgtaaatgcaacctgctccggtccatccccatggaacagtccggacagcaggtcccttgtctcatacacggtccttgcgctggtcagggctgtctcataggtacccctggaacagtttcccatggtgttaatggcctctgccactgcctctgccactgtctttggcctgtaaaaagaagtagccgcattatccagataaatcattgttaactcccgtcatttccctcagtgtttaatggccctgcttcatctccagcatcatcagcccttccaccacggagcccgcgatgcatctggccttgtctgaaatggtaaagcagttctcatactcgctcttcctcggatcgatatccgctatcttaaatccctttaccactggaaaaccatcctttatgattccccttaaaagtccggtcagggaggcctcaaccgccacctccccctgtccggtcacaaccgtcccgatcagctgtcctttttccaccatgccgccaatcattgcctttccaaggaaaatgcctttggccggtgaatggatgacccgctccgccccaacgccgccgatgattcctggtatgccggtgttgggttcggcgctgccattgccgatgatccggcccaggttatgccctctcatggtctctatcacaaggtccacatcctgacccgcggtaaatccaggccccaggccaatggtcttatccgccatgtcacggctggttcccagattccgcttggccagtatggcatccaccacagcccatggccttaccttgtcaaggacctggcattgctcatcaatcattaccgggacaaccccctgttccatcatggaacaggcttcctcatagctggaaaccttgacacaggccacgccctccacctcggctgacccgtcatacactgcttccgaaaatgccacgcaccttcggatggcagatgggaaacctgtctccaatatcagcaccgggtatccgcagcggtgaagcctgtggatggttcccgttgcaatatcgcctccgccccttacgattaccagctgctttgttctgtctgtcatcataacaattcatttccttccctgaaacgcaccgcggacaaggatccgcgatagcgcctgactcctatggacgcaccagaagcctggctcctgtcatgcgttccacaatctcatacatatttgtaacactgcccaccttcagcttatctgccagtccatagtggtttaaacaggtgccgcaggtaagtatttccacgccctgggcctccagattctttaaatcctccacattgtccgagccttcgcaggacagatatgcgccgctgttatataaaagtacggtttccggcaggctgtcctgctcggtcagggcgtatacaaaccccttcatgagaagcttcccaagggtcccgtccccctgccccatcagatttgaggacaggaccaccaccatgcctttcctgcggcagtcaggctggcagacggtatcctgggcgtctctggtatcccctgcatcagagccggttcccattcctgaaccaaccccgtcatccgggccaattccagtccctgaaacaattccgtcatccgggccaattccattccccgatccagccccgtccgttttttccggccctgctgcgcccgccgttatcctcacctggaattccctgtcaccggccttttcataggaggacttaagtcccttatggtccgccatcttgcgcaggttctggaccgctatctcattgtcaaccaccacttccactacttcccccgcatgacagcgctccaatgccttctttgtatcgataacaggaagcggacactgtttgccgcgttcatctaatctcatattttccttcatcctttcttcacatgtactgttttatttaacagtaactgccttttcttcccttggccggatttcccctacaatggcgcagggcaggcccagcttccggatttcctccagggccggggccgcatcctccctgtccatggataccagcagccctcccgaggtctgggggtcgaagaggatttcctccagggcaaaaccgcagcctgcaaattccaccttatcccccacatggttccggttgcgctgggctgcggcggtcaggtagaactcctccacatacgcctcacactccggtatgaaaggaatgctgtccctgtaaatcagggccgaatagctgtcccccagcatctcgcaaagatgtccgaggaagccaaaaccagtcacgtccgtgcatccatgcaccctgtaccttcgcacaatttcagaggcatacttgttaaggctggtcatggatctgactgccaggtccatggctgcatccgatgcctcacccatccgggaagccgtgcatacgattcccacgcccaggggcttggtaaggattaaaaggtcgccctccttacatccgctgttggcaaataccttgtccggatgtatggttcctgttacagaaaggccatacttcacatccgaatcagcaatggaatggcctcctgccagcactccccctgcctcccttaccttctcacttcctccaagaaggatctggccaaggatgtttaaatccatggcttccgggaaacagacaatgttaagggccgtcttcacatcgcctcccatggcatagatatcgctcagcgcattggccgcggctatctgcccgaatatatatggatcctccaccatgggcgggaaaaagtccagggtctgtaccatggccaggtcatctgtcagcctgtagacagccgcatcatccgagccttcatacccaatcaggagattggggtcctttgtcttgggtatcttctccaatacctttgcaagggctcccggccccagtttcgccgtgcaccctccgcctctgcagaatacaatctcttcctgtcccacgttccttcctcctgtcagttcgatgatatctttaattcctctacccattcctgtgaaaaatgcttttcaaacagccggtccagctcctgtctgctctccttcatgaaagcatcgtaagcctccaggagactgactgcctggggcgtaagggtggaaccgcctccatcccttccccctgtctcccgctcggtcagcatgaagccccaggccttttccgactcctttaacatcttccaggccttgctgtaagccatgttcatggactgggcagcgccctggagggacccagtttcctcaatcccccgcagcaaagttgacatccccggaccaaatgccttattgtcaaaatacaatttcagtgatatgccgtaatgaagctggttctgattcatttcctggcccctctcttggttatgttttcaaaagaataacgtttcccaaacaaaaaagccactccggccataccaaatacaatggctgccactggcttttacgattacctgcataaagctccaaactgctattcttccgctgcttttattatagcagattcgcctggatatgcaaatggtttttccagatcagccctgtatgatgatttcaaaatcctttcctctcatcccaaccctgcagtcccgcttatactcccctgccagcttcacgatattatccctggtgtgggccgcatctgccagcacggccaggtcctgccccggatcggcatccatctcatccatcacgatcagtaccggctccgggcaggacagtccccttacatcaatctccttcattccatctcctcctcactacttatccgatttccgtttacagctaaaaccaatgatgaacagcaccgcaatacatacgacgcacatgatccttccggcaggcgtggtacccgtaccgctggaagccagcccgaagttatggcagaaggcagcgcctgcagacatccccagcacattgacggccgcatccccggaaccttgtccagccaggatcagctgcctcaaaggacatcctcctgccagcaccgcggcaaagccgaccacatacattcccgccatgttccacagcgcctcggtatgcgccactggctgtcctgcaaatcccggtttaaatcctcctgttgcaaggttatataccgtcatcacggcaaacaggccgatgatgaccgtcagcaggtcaaaattcttcatgagaatcacatccctgatgcctcctgcaaagcaggtccttgaccgctgtgccgccgcgccgaatatgaggccgcctgccagggatgccgccacaggcgcatgcatgctgccagggccttcggtacttgccgcaaacagcggcgtcaggatgctcagcagaagcaggaccgccagaatggcaggaaggatatagccgctttcctttcttgtatcataggcccgccccaggctgaatccctttttcaggaaaaagcaccctgtggctgcccccagcacaaaaccggccagacccacatatgcgttccagtcaccggcagccatcctgagcaccatgcgcagcggacagcccaggaatataagggcccctatcatggtcaccatgccaagaaggaaccgtatcatgggcgatgaaccggatgtggaacggtattcctttcccagcagggataggacaaaggagcctgccgccagacctgcaatctccggtctcatatattggaccaccccagccgtgtgcagcttacatgcgcctgcgatatccctgataaagcatgcgatgcaaaatgccatgttccccgggtttcccatgaatgccagcgcggcagccaccagccccaatatgcctccccatagtaacagccctgtttttgagttccatttcccctccattgtttcatttcctccattcgttattttctaaaaagaataacgctttcaataaataaaaccggtctgaccaactcaggactgtggtcaaaaccggctttttcagaatttgtgcgcaaagctccaaactgttattccttttatggagacaaatataccataaaatgccatttcagtcaatatggtgcctgtctaataccgctgttttctttgagccagccggtcccccaactgcctcatagcccaaaaaacctcaaaacagaatcaatctggctgtcccagaatatccagtcatgattccccgctgcttgcgtgtattggtattccagtccgggcatttcctgcttcagccaccttgaaaattccagattcacaggatacaaaggatcctccgttcctatggactgcattattttaggccagtccgccgcatcccttttcttcagatccagacatttctgccttaaatcgtattctgagccgtccgcctgctccggacatccgaagcagtcagcgatattttccctgaaatccggaacggaaaacatctggctgcccacatccaggacagcgcccggcgtaaccgcggccgacagcgccgccgcccccgcatattgttccgggcaggacaaggcaagataaagggcgccgtatcctcccatggacaggcctgcaatataattatccttccgttccagggaaccgtggaaaaaattcccaaccgcccggggcagctcctttgccaggtaatcaaaataccggtagccatgtttcccattgatgtaaaatcccctatgggccgtgggcattaccacaatcagttccctgtccctcaccttaagttccagcatgctcttcctgatccacccggtctggtcatccccatgtccgtgaagcaaatacagtaccggatatttcttatgggagtcatctgatatgggcatgcccctctcctccggcaaaagcgccatcacagacgtgttcatcccaagatagtaggaaaaaaagttcaactccgccaatgccatccctgttaccctcccttatattattttcgctgctccgccagaagcatgcgctggaaattcgcgcccgcggaccggatgaattcctgccactccccggaatcgataaacggattgtctccgtctttttggcttttcattttttcatatttttccagtgtatgattctgggccgcgtgattgcccagtgtaatatccactttttcattgcggattttctcaagactttccgggaactgccgcctgcactgggaattgtggtaacgggcaatgaaatccgatgtcattgtattcacacccgccccgccgaaaagccctgcccgaaggacgttcgtcccatcggccacatcaaagaaaaacgacatgaccccatccgtgtgccccggtgtcgcgaccgctttgatttctgtattccccagagaaatgatgtccccgtcgcggatttccacatccgggacaaagggttcggtatacgcatatcccctgcaatccgcacagagggccagctgcggctgttcacagaacatcctggcgtccgcctcccccagaaaggtcctggccccggacagcgccttaatcagcgcggtcccgccaaaatggtcaaaatgtccatgggtatgcaaaatgatacgtatatcctccggccggaatcccagttcccagattgactggattaagagcgccgccgtggacggataagtggtgtcaatcaggataaggccatccccgctgtcaatcaggtgcgcgcccacatccgcatttcccacataatacaggttcccaaatatacggaacggtaaaacccggtatttctccggatatttataaagtccgtacagcttcttaatatccatgtcaaattcagtagccatatgtaagcatccctcctatcatctcatcaaaaggttgggtatggttgtaacaatctgcgggaatatcccgcaggccacaagcacacatacaatcactgccaggaacggcagtacggcccgggctgtttttgtcacggagacattccccaccccgctgatgacaaacagcagtccccccacaggaggcgtgatgttaccgaccactgcggtggtacagaggattacgccaaaggccaccgggtcaatccccacctgctggatgaccggaaacagcagcggcgccagtaccgggacaatggcggcatccgccagaaagcagccaaggaagagcacgaatgcgattatgataagcatcagtatctgcggctgcgaggatattccgataagcagccttgtcatcatctgcgggatctgcaggcttgtcagaatccacccgaacaccgctcccgtccccattaagaacaggatgttggtgctggacttagctgcgttgagcaggatcctctttacatcgcttatgtggatctcaccgctgagaaagcccaccgcccccgcgtatgccacaccgattgcccctgcttccgtggctgtaaacatgccggacaggatacctccgataatcacgattggcaggagcagagccgccagggatttcctgaaggacaccatgatttccttcagggagcatcgtctggcaagcttcgcctggtagcccctttttttggaaatacggtaggccgtgaacatcaaaagcattcctatgatgattcccggggcaataccgcctaaaaaaagctttgcaacggaagtgcctgtcagggaagcgtaaaccaccatgatgatgctgggcggaatcaccggccccaacaccgccgcgctggcgatgaccgccgcactgaagtccacatcataattctctttcttaagggccgggatcatcatggaacccactgaaacccctgcagccgtacaggaaccgcacatgcccgcaaaaatcatgcaggccaggatactgatatgtgcaagccctcctgttatatgtcccaccagcttagatgagaaatccacaattttacgggtaatcccgccgctgttcatcagttcgcccgccaatatgaacaggggaatcgccatcaatgcaaaggaatcaaccgtaacaaacatccgctgcggaatcaggatggccgggatattcggcgtcagcaggatgtacaccatggccgccagccccgtggcaaaactgataggcaatccgctgattaaaagtacaaaaaaaagaatccccattatgattgctgcattcattcctccaccttcccctccccgcttccttccctgaagtcccatatggcgcgccggatactgttaatccccatgaacacgccggaaaatggaatcgtcatgtaaacccaccccagcgggatccgcagggccggagacacctgatacatatttttaaccgcaagctcccagcctgcttttgccaggaacagggagaacaggaacatcaaagcatagagcaggaggctgtaatagcgccttaccctgcacggcagctgctgtattatgatatccacgcacacgtgtcccttgtccctgacgcagataatgccaccgaaaaataccaccaccgagaataaataccggctggcctcctccgaccatgggatagaactgttaaacacataccggaataccacctgtgtgaaacagaacaccgccattgcaaaggtgcagcttaccagcacccattccagtatactgtcaaaaatcctccaaatctgtttcataaaaaaccctccatttacaaggggcaggcataggcgtctgaacatccattcccgccatatgcgcgccccaaaaccgtctattcagccatggcccggatctggtcaattgtctcctggtcaatcacatccttaaaatatttctccgaaacaccgttcatggcttcccggaactgcgccatcatctcctcggacgggatgatctgctggattccgctttccgcaattaccttctcgtatttctcagtatccgtgaccatgttggcccggtccgcatcggaggcctccttaaccgccgccagcagcatctgctgctgttccccggtcagcgactgataatatccctcattaatcagaaccaccatggccccgcttacatggtttgtaaccgtctcatacttgaccacttcattaattttgccgcccacaatggagctgacgggaagttcaaccccctcgatcattcctgtctgcagggccgtataaacgtcccccgccggaagcggcgtcgcattgcagccaagggtagtgaacatatcaacaaaaatcggtatctccgggacccgaagcttcagccccttaaaatcagacagggattcaaccggcttatccttggtccagaccgtgcggaacccttcattaaacaggccgattacacgcattcccttctggtcgcaaaaatcctggaggatcttctggttgatatcgctgtcatagaacttatagagatggtcgttatcctcaaacaggaacggcatcccatagatggaaaacctgggttcaaatgattctaaggcccctacgcctacgatacacatttccacggtccccatggaaacgccttccacgaaatcacgctgtccccccaactggctggctgggaatatctggatatcaacagcgccctgtgtctcatccttaagcttaacgctcatgtctgtcagacatttgataggcgacgtgtccggcatcagggttgccgccagcttcatcactttctgttcctgagcgctgccctcattattttctgccgcagcggactgtggctgcgcttgggtggaagtttcggatacggttcctttatttgaaccgcagccgctgattaccatgctgctcacggtcgccaatgccataatacccataatggaacgttttgacgcacgacacaattttttcaatatcatacctttatctcctctcaatccatggaccttcgtccatccttcataacggttctcttattttaccggcggccgcctggcttgtttttactatacccacagctttcccaaatgtaaatgacgtttcctgtggattgttcacaattctttcatcagcaaaaaaaatgttaatcatcacagatatcattcattgcggacatccccgccattgggccggtccaccctgacccagcctgcccagacccggtccaacctgacccagtccaacctgacccagcccacacaaaacgggccggaaggaatcctattccctccggcccgttcccggtaccgctaaccacgcttcaaatccctgtactgaccgggtgtgacattctcatatcgcttaaatacccggataaaattctggaccgagttaaatcctgtcctgtaaccaatctccttcacggtcagacggtttgtcatcaacagctttttcgcctcctcaacccggcattcgttcaggtagtcattaaaatgcttatgcagcgcctccgtaaaaagcttgctcagataggacggattcaccccaagatacccggccaccccgttgagtgacaatgaactgtccgaataatgctcatcgatgtagctccgggcggcgacgatgaatttatgacgccgttttttataatagccctccagcagggataccagcccgcgtcccgcctcctgtgcctttccggtcagttcctccaccgtcctgtccccgtatcctgaatccaggcccgtatccccctccggccggtcaacatgcagctcaatcaggcattcctccatcgcgttgcaatagtcggtcaatgcctcccgggccttctgcccgttttccgtatctgaggtacactccgaaagaagacggtccgccagggcctgtgcgcccgccatgtcctcctcttccaccatctttgccacctgccccacacgcatgcggtaatattccagctgtgaccgcggttcattcggcgccccgccgccctcattttccccggtgctctgatccatataacggatatacatcagctgttcgcgcgcctgctgaaaggaaaatccaatgtcctccatggaatcatatacctgtccgcggccaatctggacctggaaggtggcattctgtaccgcgctgcagaaatcgcgtatcaggccggatgtaaactcctttaccttaaacacggcagtccggcggtcaaattccagaaccgcagccgccagattcccctcatacaattggacatggagggcgcagtccgtgcctgccagcttgtacagcaggttccttgcacctacgaaatatacccccgcttcaacttcgttcaattgtccgctttccggggtcgtcaggaggatggccagcgcaacatatcttccctcacagccaaacacgcttccgacccttgtaaacgcggcacggaggtccgtccccggctcccagtgtcccgacaaaaggtcgcggaacagctttttctcgatatccggtgcaatctcccggatgaccgcgttcaaatcactgttctgcaccgccgcatggtcgaaggcggcggtcagcagatcatactcgttgcgtatatctgccccgtccgatggcaagggcatccctttccgggtgacagaggacagcagacggttaatgggcgcataaatcgtacgggttatgtatagggaaaggaacaggctgacaaaaaagaacatgatgagcagcggcaggattaaaagcaggatatcggatatctccggcgcaaaaagatggcggtcttccaaaagcacatatccccacccggtcagggcggaggtgacccggaacgtcagcccctccccgttatccgtataaccgtccatatacccggctatctgcatttcctcccggggagccatgcccttcccatggcgcgccagcccgtccccgccatccccgccgggcaccggcccgccaaacagttcctctcctcctgcatccatcacaaggatacggcccgacagcgcctgccggcccgctgccagctggcggaacgcctccggggacagcttataaaacagggtccccagacggttgatcccggtcatgggaaaatcccggaccatatacacgtcgtccccatagtggaacaggcgtgtatcggtactgccgaatgccgcactaccggaagcattttcaatgaacgtttccacggtatcccttccctcataccggtcaaggggagtgactttctgactggatgtatatacggtacgggaaaatggcacatacagcaggatttcctcaacggaaggattcttcccggcggacgcatgcagcaggttcgccacctcaaaatcccgctgcccctgttcagacggcgcaaccacggtgctgatgatattctcattctcactgacctgggtaatgctctgattgatataagaaagcgtcaggtcaatggcatcacatgtcttccccagcatattcaggttagaaagacagaacttctccgttatctggtccgaaaccaccttataactgaaaccataaaaaatcatgatcagcaaaaacatcagcccgattaggattgccagtgtttttgtgaaaatactcctgtatttgtacctgctgataaatcttaagtccatgtcccgccccttttgtccaccccatgatggatcatgattgattgtaccgtattgcatatcccccctatccccggatatgcagtatgaaaatattatactgtaggacaaattctttcgcaatacgggagggggattttattcctgccctcccggttccgcttacgcagccctgcctttgcttcagccgcaaatcccataccgccgcatcaccgcagccagccgctccttctgcttccgtcccatcggcgttaacggcaggcggcagctgtcggaacacacacccatgatggacagggccgccttgacaggaatgggattcacgtcccagaacagcgcctccatgatgtccaaaagcttcagctgcatttcccggctctccttaagcttcccgtccaggaacaggcggcacatgtcatgggtctgtccgggcatgatgtttgccagtacggaaatcactcctttgcccccaagggccatgatgggcagggtctggtcgtcattgcccgaatagatgtcgaatccgtccccgcagagcgcggccgtcctggccagggccgtcatattgccgctggcctcctttgtccccctgatgttggggtgttcggaaaggatcttatatgtctccggccggatgtccacgccggtacggctaggcacattatacaaaaggatgggaatccccacatggtcccccacctccgtaaaatgccgcaccagcccttcctgggacgccttgttgtaataaggcgttacctgcaaaagtccatccgcccccagtttttcagcttccctggaaagctttaccgcatgttccgtgcagttgctccctgtcccggcaatcacgggaatcctcccgtccacatggcggatcacatactccatcacagacagcttctccctgtcgtccagggtagcggactccccggtggtcccattgacaacaaccgcatcggtccccccgtccacgatccggtcaaggagcctgcccattgcttcataatccaggttgccgtattcatccatgggcgttactatggcagccgcgctgccttcaaatatgctgtgtctcatttactctctgtcccccggttcattctctatactatcagaaatatgacaaacatccgccattggtaccactcaccaattatttccttttcacatataacaaaatataatgagatgaaaggagttccttatgcatcactttctcattctgggcggcgaccccagacagctttacctgtcacgcctgttagaacaggcagggcaggaagtatccttatattatgaaaatccctccttttccctgggggaagcaatggaggattccgatatcatcctctgccctgtgccattttcaaaggataaaaaaaacatccacgctgaaaaccagcttaaggacatggatataaacaccttcttaagccgcctcacatccgcccacacactgtttggcggcagtatccccctgtctgtcacggagtactgcaaggcccatgacatcccctgcattgacttcatgaaactggaagaggtggcctgtaaaaatgccgttgccactgcggagggcgctgtggccgaggccatttccctaagtcccatgaacctgcggggaagttcctgcctgataacgggatgcggccggtgcgccgaggcgctggcagatacgcttacaggcatgggcgcccatgtggcccttgcggggcgggatgcgaaaaagctggcgcgcgcctggtgccacggctatggggcggttccccttgcgcagctggattcccatatccacggatattcatttatcttcaacaccataccgtccatggttttagatgcaggtcttgctgccctcatggccagggacacggttgtcattgacattgcctcggccccgggcggggttgaccttgaggcctgcaatgcacacggcatccgtgccaggctctgccccggccttcccggcaagtactcacccatgtcctctgcacggatcctgtatgaggccctgtgttcccgcatctgaaaaccataggcgcggcctgttagaaaggagttttttatggaattaaaaggaaaaagtatcggcctggccatgaccgggtccttttgtacgtttgcaaggatggaacaggaaatcctgaagctgaaggaaaccggggccatcctgtaccccattttctccggcaatgtccagaccacggactcccgttttggggataccggggaattcatcaaacggataaccggcatggccggaaatcctcccatcctgcgcatcgaggaggcggagccaattggccccagggcatatctggatgtgctcctcattgccccctgcaccggcaataccctggctaagctggcctgcgggatcacggacacccctgtgctcatggccgccaaggcccatctgaggaacgggaagcccctggtcatctccgtgtccaccaatgatgccctggggattaactttaagaatatcggggaactgtttaacaccaagaacatctatttcgtgccctttggccaggatgacccggtgaaaaagcccagttccatgatagccaggaccggactgattgaggatacattaaaagaagccctggaaggcaggcagatccagcctgtcatccggggctggcagtgatggatatccaaaccattcatccgcgctccagggatattcctctctgatacacctgctccgccagtctgtaggaaatatcataggccatggacccactgccctttaggggtatccggcatccatgggcgccgctctgcacttcctcccacaggcgcttaaattccttcacagccttctccgtcatgccgccgggcgtggcgtggtccttcagcttctcctccaggaactgcctggactcaagctgaagggagagcaggtgaagctcaaatgcctgaggcgcaaggacccggacattgggggacggcgcgccgtccggcaacctgccatgtccggcggcaaagtcaaatgccccctcgtaccaccccttctccagccaggccaactgtcttttatccgcctcctccggttccgccacaggctttacaagtcccggcctacccagtctcccacagtttaaggcgtataatattcccgccgcccttgcgcacccccctgccccataatgtccttccagggcaaagcagagaagatacagcatatggtacgtaatattcatggataaaagggccatggactcctcgggcgtacaccataacaccttgcccaacggctcaaggaaacggccgacggcttccctgtgcccttcggccaggggaatcccctggtcatatgtaacctggctgctggccagggaatacacgtcgacgcctccaatggatgtctccatggccggaagcacgcatacggtcctcacatcctctcccaggacctgcgtataccattccgggcgcgggctgggggcaaatgaaattatcaggggcatgggggcgccctggttcctcaggaaccctatataaggctttaccgtgccttccaccacaccggccatctcgtaaggccggaccgaaaggaccaggaaggcgggtcttaaggccttcagccgttccaggcagtcccctgtcatgatctcaaatccataccgtttccttaattcctcaagccgcctgtccgttgccttgactgccagtatcctggactcataaccatttcccagaaggcgttcatagcacgggaccatatattccccaatccatcccatgccgatgacagccagtccggctttcccataatcaatcatatatccttaaccttctcccatccaacctgtacatatccttaaccttccccatccaacctgtacatatccttaaccttccccatccaacctgtacatatccttaaccttccccatccaacctgtacatatccttaaccttccccatccaacctgtctgaacagccgcttcccgccttacaggaacagttcattctcccttcggattgccttgaccggggccagcttctgctccagcatggcctgggcctgggcgggcagcgaccttgcgtggaccggacagacagcaacgcagcgcatgcacagcatacaggtccctgaattggtcgtacctggcgcatccgcgggtatggccccggtgggacattgttctgcacaaaggccgcaggctatgcaggtatcatctgcaaggggaacaaccggcatctgtttccagtcgcggtaaggccggtctcccgggacctggggttcctgccatccgtcctttgccagcttctccaggattcttcctgcaaatccacgggcatcctcctcatcctttttatccgggcgtcctgctgcaacctcccttgccatggaatgctcggccagaagggcggcgcttgccccgatcttaaatcccagttcctttagggcatcatttaattctaccagggcgtcctcaaaagcacggttgccataaacagccacggtaacggccactgccccgttccccctgcactgcttaagcagctttgccgcaaaccccggaatcctgcctccaaacaccggcatccccactatcacaaggtccccggattcaaaggagcactctcccttcagggtgcaaaggtccacctccctgatgtctccccccatcccggatgccaggttaaggacggccttccttgtgccgcctgtggggctgaaatatactgctgatatgttcttcatgcttctgcctcctatatgtaatatttttccattcctgtgacatgataccaggatttaactgtatcagcttttccggtatttttcaataccatggtcatgtttcgggatgtaaactgatcaggcctcctagagcgtgtttgaaaattcattcccgccatctgcacgccccacttcgcggcatatttggtcccaattcggtcaacgtagcccgctacgcctccctcatcgggaccaaatctcccacaaagtgggacgcacagctgacggaaagcaattttcaaacacgctctagtaagacaaggcagaggctgccagcttatcgccgcagacctctgccttcgtacattcaggattttatatcaataaagtgtatttcctgcgtttagcaaacctatatacagcatttctcacgctcaccaaacctgtacacagcatttttagcacttaaaaaacctacagatcatacttcccgcgcttaacaaacttacctgccttctccaccacaacctgatggtccctcaccacctgggtgccgcgcaggtacacgctttcgatgcgcgcggtcagcttccttccctcaaagggcgcatagtccacgttctgtatctggtcaccggccgttaccacgtcatccacaccggtccgcatcaccacgatgtccgcgtcgcttcccggcgcaattgcgccttttaacggatacatgccgtacagcttagccggattctccgacaggagttcacacatcttttccctggtaatccttcctgtatccacgccgtatgtataaagaagggttcctcttgtctcaacccccggcataccgcccggtatcttggtgaaatcatccatgccaagctttttctgctccgtggtaaagctgcagtgatccgtggaaaccgtctgtatggtgccgtcagccagggccttccacaggcactgggaatcctcctttttccttaatggaggcgcacacacgtatttagcgccttcaaagcccggaagtccgtaaaggctgtcatccataagcaggtactggggacaggtctccgcgtatatcttctgccctcttctccttgcttccatgatgacatcatagccttccttacaggtaaggtgcaccacgattacagggatatccaccacctctgccaggcgcagcaggcggtcaatggcctctgcctccgcggcagccggacgcgtggccggatggctttcaacccccatccttcccgctgcctttgcctctgcctggagggccgcaatcatgccgctgttctcacagtgcactccagtaatcccgcccacttccttcagcctcctaaggatttcgaagattgtcctgtcatccacctgggtatcataagtcatgtacagcttgaaggaagtaatgccttcttccatcatatcatccagttccctgctgaccgatgggttccagtccgaaatggacatgtggaagctgtagtcgcaggagcatttgccgtccgccttttcatgccagttcctaagcccgtccgccaggctctcgcccgcatactgggtgccgaagtccacgattgtggtggtgccgcccctgacagctgccctggttcccgttgtaaagtcatccgcggtcacggttcctgccacatgcaggtcaaaatgggtgtgggcatcaatgaatccagggaacagaagacagcctgtcacatccgccacctgggtgtcctggtccgccagacgcgcgatttcttccgtactgcctacagcagccaccttttccccgtcaatgagcacatcctcccggaaactgccgcttccggtcaccactgtcccgccttttaatatctgcttcataatcctcactctcctgttctgtctatgtgataaagctgttgtccctgatccgccatccggcttaactgctccccgtctatccggtagaccgtccagtcgctcatggccttggcgcccatgcccagataaaagtcaatacttggcttattccagtccagacaccaccactccagacggccgcatccccgttccactgcaatggaagccagctggtttaaaaatgccttcccaaatccacggccccggtacccgggacatacatataaatcttccagataaatgcctgcccggcccaggaaggtggaaaagttatggaaaaacaaggcaaagcccacggtttccccgtcacagcttccaagaagcacctccgccttctgcttttcaaacagccactggtccagcagttcctccgtagccaccacctggtccagcatcccctcataatcagcaagttcctttatgaacctgagaatcagggggatatctccccgctccgcgaaacggaacctgattgtaccatccatcccgtcacctcctgtaatatgtttcgtccaaacatgcgcttatgtggaacaagcgaaaagcaggatacctgcctttcgccgtccgtttcagatacctggtcaggaaatccccctccccggggcctgtttgaaaatccattcccagcatctgccgtttattcatttatttctttttcttatagaatgtattctccataggaagctttgtcctcagcacatggtccatggcgtaataagcgccctggactgccggggccgtggggatggtggcaatctcgccgattccctttgcgccgtatgcaaatggcagctgttcttccttctccacataaatcgcatggatatccggaatctgtgtggaacgcatcagtcccagtgtgccgtacttggcctgcggaacgccgttcttcaatgggaaatcctctgtcagggcatatcccagtcccatcagcacgccgccttcaatctgtccctggatggaaatcgggttcacgaccttgcctgaatcatgggcagcatacacctcttttaccttgccgtcatcgtccaggatgaccacatgggttgcaaaaccataggccacatggctctttggattggggacatccgctcccagcttgtctgtggggtcaaagaattcagcaaagaactccctgccttccagctgtgtcatgtcaccgccggcttccttaagggcctccaaaaggtctgccgcggccatcctcaccgcctcgcccgtaatcagggtctggcgtgaaccggaggtggtgcctgaatccggtgcaacctcggaattggcgcccatgttcttaatctggtccttcttaagtcctgttacctctgcaaccatctgtacaaatacggttgcgcagccctgtccgatgtcggaagcagccgcatataactccacccttccatcatggaccgcaagctttgcgcgccccttgtcaggaaggcccacgcccacgcctgcgttcttcatggcacatgcgattcctgccctgccgggattgccctcatatgcatccttaaccgccataagtgtttccttcagcgcggtggagcagtcggcaatctgtccgttgggaagcaccttgcctggttcgattgcattgcggtagcggatttcccatggggaaatgcccaccttctcagccagaaggttgatattggattccagcgcaaattcactctggcacacgccaaagccgcggaacgcgcctgcaggcggattgttggtgtaatagccgaagccgcggatatccgtgttctgatagcagtatggtcccacggaatgggtgcaggccctttcaagcacgggtccgcacagggaggcatatgcgcctgtatcaaagtaaatctcacagtcaagtcctgtgaagattccgttttcatcacagcccagggtgaaggttccttccattgcatggcgctttggatggaaattaatggactcctgtctggagaatattaccttaaccggcttctgtacctttaaggctgccagtacggcgatatgctgggtggaaacgtcctcttttccgccaaaaccgccgccaaccagtttgttttccaccacaatgcggtccgggtcccagcccagcatgatggagatttccttacgtgtatcgtatacgccctggtctgaggtataaaccttgacaccatccttataaggaaatgcaactgcgcattccggctccaggaacccatgctctgtaaacggagtggtgtaggtctgggtcaccacgtacttggaattctccagcgccttttttgcatcgccgcgtgtcacatggcggctctggcacagatttcccttttcatggaccttgggcgcgtcctcagccatggcctcatggacagaacataccggggtcagttcctcgtaatcaaccttaaccagcttctttgcttcctccaggatatcccttgtctcggcaacaaccaggcatatggcatcgcccacgcagcgggtgatatcgccttttgcaatcatcacatcccagtcctgctggagatggcccaccttattattaggcacatcctcggccgtaagcacggccaatactcccggaagggccagcgcctccccggtgtggatatccagcacctttgcccgcggatacttagaacgaacggctgatgcataaaccattccttccatctccacatcgccagggtattcgccgtatcccagcaccttttcccgcacatccaggcggaaggcacgctctcccaccccgtaggaatcgcccttttccagggactcctctatcttcgcatcccctctcaggatggctgcggtcagctggatgccttcgatgattttcttatatccggtacagcggcagatatttcccttcagggcaaccttgatttcttcctcagtggggtccggcaccctgtcaatcagggccttgcccgccataaccatgccgggggtacagaatccgcactgcacggatcccattgcgccgaaggcgtatacaaatgcctccttctcagcatcgcttaagccttccgtggtaatgatgttcttccccactgcgcgcttggttgtcaggatgcaggatttaaccgccttcccgtccaccacgattgtacatgtgccgcaggcgccctcgctgcatccgtcctttacagaatgcaggtgaaggtcctcacgcagataacgcagaagaggtttatcctcactggtgctgcgcatcactccatttaccgtaaaactatagttctctcccatctttacctcctgcctttacgctccaacgtaaaatagctttataaaaaaagattatggattccctctgtctctatcccgttttcctgaatcagtgattccagccctggccgttctgctgccggggcgctccaggccatgccgcagccggcgctgatctgccttggcacaggtatcagccgccccgggcttcctgcatcctttgcgcactgctccatcctcatagccatcgtcgtggtatggaaggtaaataccaccttttccgtcttttccctagccatccgaaaacacctcatcaatctgccgtgatcctgtcacagacagaagttcctgtctttattctaccaaaagaataacgttatttttttaacaattcagcgcgtgtttgaaaatcacattcctctccctgtcctgcggactgccggattggggcgtgtttaaaaattgctttccgtcagctgtgcgtcccattttgtgggagatttggttccgatgagggaggcgtagcgggctacgttgaccgaatcgggaccaaatataccgcgaagtggggcgtgcagatggcgggaatgaattttcaaacacgccccaggaccggacaaaccgcgaagctggtcctgctttgtcctaaggggtacctttgatggcttcatcagggcagggggaatggactttcaaacacgcactggaatataaggaaatccccctatcttcaccgggaacttcctgctgcgccaggatatgtttaaaattcattcccgtcagctgacggaacacaattttcaaacacaccccggggctgtcagacacacctgcagcccccggcgcacattttcatttataacatataagaataatctttgattacagttgcaatgatcttctggattccgtccggcacatccccgttcgcggaaccaaccgtgtaatccatcacattgccctggagccttaccttgcaggcgccgctcacagcatccagaaccgtgaagccctggttcttgctgttttccatatccttctcattggcaaacagggtgaacttgtcaagatacggcgcgctgtcccatggacagaagctcttacagttgccgcactcattacacatataatccacatggatgatctggtgcttctccattcccgggacaaccagggaaatgttggccctgttggggcatacctctacgcagttctcgcagtagctgttacaggacaggcatctggtgctgtcaacgatatggtcattctcctctgccagcctgcccttgcggccatagatggtgccagcgtcagacagcttgaacaggtcttctgccagtaccttgcccacaattgcctctgcggccatcttgccgtcgcggattccgtcaacaaccgtggcaggtccatacaggccgtcgccagccacgtacacgcccttcacgctggtttccagggtatcctggtttacctggggacgtcttctgctgtccagggcaatgccgcattcctcgtagaatgcgcccggaaccttctcgcccacggctgcgataaccgtatcagccggcacggtcacaacctcgtccgtctccacgacgcctcggcgtccgctggcatcatagtcgcccaggaccatcttcctgcagtacagggttttgtcctccagcttaaccggggccagaagctcggcaaattccacgccgtcctccattgccatcaccagttcttcctcgtcagcaggcatgaagcgtctggtccttctgtataccagggaaaccttctccacacccgcgttcctcttagccgcccttgcggtatccatggcagtgttgccgccgccgatgacaaccacgttcttacctaaatccagcttgccgtccgttgccttgaactgagccaggaaatccaatgcattcatggtatcccctgcttccagcttaagggttcccttatcagaagcgcccactgccaggacaacgtaatcatattccttctttaactcatcaatggaagtgatttcctttccattcaccatctccacgcccatggctgcaacaatcttcacatcgttgtcaatggcttcatcggagatacggaatcccggaatcacgttgcggacaacgccgcccatctttgcttccttttcaaagacagttacctttacgccgcccctggccaggaagtaagcagccgccagtcctgccggtcctccgcccacaacagcagccttcttatccgtggtcactgccggagccttgaacttagacatcactgcctcaaagccgccttcagctgcttccagcttggtccttctgatatccacaggactctcgtagaagttcctggtacatttactcatacagttgtgtgcacagatggtgcctgtgatgaatggaagcgggttcttgttcaggatgacttccagggcctgttcaaactcaccggctccggccagctgcagatagcgggtgatatcctggtggatcggacagccttcctgacacggggccacgaaacagtctgtcagcggtaccggcttcttaatcttcctggagggaaggggttttactgcctttacatggtgcttgtcgctcttgacagcctctaccagtgcagccaccttatcagcatccacgcctgtgaacgcagccgcatcctttcctgcaaaaatctggccgatctgctccagcctctcatagccgcccggctttaacatggtggttgccatggtcacgggccagatgcctgcatccacgatatcttctatattaaagtaatcagcgccgcctgagtaggaaatgcgcagcttgccgccaaagtccttagccagcttcatggcaactgacatggataagggatacagggacttgccggacatgtacatctcttcgcttggaagttcattctgcttcacgtcaaccgggaaggtgttggtaatcttaacgccgaattccagtcccttctcatcagccagggcctgtaacctctcaagcatgggaaccgcatcctcatactgaaggtcatccctgaagtggaaatcgccgaatgcaacgtagtcatagcccatgtcgtccataagcttccttgcgtactcatatcccagaagggtggggttgcatttgatgaaggtatgtactttcttctcctcaatcaggtaacgggcaatgcgctcaatctcctgcggaggacatccgtgaagggtggaaagggttgcgcagttgcagacctgcggggagattccctccacatcttcctttgtcaccttctcaaacttgtcaaggttatcgaggagccactgcctgcactcattgaaaacagctgtcccggatgcatccttcatgccctcgatgaaccggtcaatcttctccagcttaatgccctccaggtcatatccaacagacatgttgaactggaacccgtccatggcaccaaggccgtattccttagccagcaccttacatgcgaaccatgctttcacatactcgtcaaatgcctggggaacatacagctccgtggaccactcacagttatagcactcgtcatccgccttgatacatggctttgcaacaggaaggtcctcgccgtccagcttctgtacggtcttcagttcaaagaaacggctgccggctacataagccgcaacaatattctgggtcagctgggtgtgggggcctgccgcgggaccgaagggtgtctccagcttgcggccgaatatctcataattcttttccgggtctgccttaaaaggtttcctgactccgaaaacagcaccttttttgtgctcttttagaatccagttcatcaggtttccaaatggaatgggtgtcatgatatcgctcattttattcttatcctccttattataagcaccagaccaggtcccagcaccggacacaagggccgcggggcttagaaatcccccaggccaatgtcctccatccggctcagccgcccagggtatgtttccctgaggtgctgattcccgccgccctgcaatcagttgtttacttaattatacatgctgcgccttcttcattatagaggaaagcctatccaggcctggaaggcagttccttccatccgcgcatccttaaccgttgatggaacgctccagcttcttagcctcttcccttacctcataaaggatcttctcctcatccaggccaatcagttcccggtctttcataaggaccttgccgttacatacagtggtgatgacgctccttccggtcattccgaacaggatgtgtccgttgatgttggaagcatccatcggtgttaacgggatgtagtcggttacgatcacatctgcggcagcgccttccttgagcacaccgagaggcttcttgaagtaacggcccgcaatctttgcattgccctcaaagagcatctggggaacctcgccccatgccgcgttggcatcgcacaggtgatgcttatgcagtacattggccaccttcatggactcggtcatgtcatgtgtatagccgtccgttccaagaccggttaaaatacccctgtgcacgatctccatggttggagggcatccgcaggcattgcccatgttggactcggggttatgtacgaccatggtatccgtatccttaatcagatccatctcatgggaatttacatagatacagtggcctaacagtgtcttgcttcctaagatattgttgtccatgagacggtccacaatcctcttgccgtacttcttaaggcagtcgtgaaggtcctcaatgccctcagccacatggatgtggtatcccacttcgtcaggcttgttggccgctgccagctccatggtctcatcggaaatggtaaactgtgcgtgcatacccatcatgcctgccagcatgtctgtcccatcagccagggcatgcttgatccaggccgcattctccataacggcagcccttgccttgtccatgccgtccctgtccgaaacctcatagcagaggcaggtcctgatacccatctccttggcagcatcctcgatggcaaaaaggctgtcgtggatctcgccaaagctggcatgatggtcaaacacagtggtgacgccgttcttgatggaatccagataagtggcccttgcgctctggcgggtctgctcgttggtcagatggcggtcaatggtccaccacatcccgtccaggatatccaaaaatcctttcgggttatatcccttaatagaaagtcctctggccatggcgctgtagatgtgctcatgggtattgatgaacgccggcatgatgacgccccccttggcgtcaatgaactcagcctccgggaattccttcttcacttcttccagtgtccctactttcttaatcacattcccgtccattgccaccgcgccattctcaatgaatggattagcggcatcccttgtcaccagacgtccgttcccaataactaacataacctctctccttttcttttatagaatactttaaatgaattatatgtgtcagacagaaacaatttgtcctaaatcccatcttaaaaccataaactttaataagatagaacaggacttcctgtaaccctatactaacaccttataaccccatttgcaagcataaaatgcaaaattttttagatattctaaatttttttgtaaaaacctcttgcaattcattttttttgtgctatgatggaatcataaacaacgcgtcacaacatagcgaaatgtttattgtacaaagtaaccagaaactgattggaatttgaagagtccgaagaaaggaagaagaaagctatggcatacacactagaccttttaaagcagcttgctgatggcctggcaaggcagttcggaccagactgtgaaattgtgatccacgacctggcaaggcatgacctggaacactccattgtacatatcaataatgggcacgtgaccaaccgccaggaaggcgacggaccctccaaggtagttctggagacccttcacaaggatccggccactttaaaagaccatcttggataccttacccgtacatccaacggcaagatactgaaatccagtaccttttatatccgtaataaggaaggcgattccattgattacctgctttcccttaattatgatataaccggactgatgaccgtggaccgttccatcaaagccctcatcgataccgaaccccaagcggacgtgaagcagcagcccgaacagattgtccacaatgtcaatgacctgttagacaccctgattgaacagtcggtggcccttatcgggaagccggccgcccttatgaataaggaggaaaaagtaactgccatccagttcttaaacgatgcaggcgccttccttatcactaagtcgggtgacaaagtttccaagtacttcggaatctccaaattcactttgtacagttacattgacgttaacagccgcaaggcagatgataagaaataacattataatcataaacagcaacacacatacaaggaggattatgtaatatggatcagaagattcaatgggcggtcaatcatatgccaaagacagatgataagaacctgccgatcatgggccttgaggaaatcggaaaggcaaggaccttccacgaaagctttcctcagtacagcaagacaccacttacaaagctggaccacatggctgagtacctgggagtaaaagagatttacttaaaggatgagtcctaccgctttggcctgaacgcatttaaagtactgggcggttccttcgcaatggcgcgctacattgccagcgagacaggcaaggatgtgtccgagcttccttattccgtcctcacttctgaccagttaagaaaagaatttggccaggcaaccttcttcacagccacagacggcaaccacggccgcggcgttgcatgggcagccaaccgcttaggccagaaggccgttgtacatatgcctaagggttccacccagacacgtcttcagaacatcgcaaaggaaggcgcacaggtagacatccaggagatgaactacgatgactgtgtacgtctggcagccaaagaggcggacgagacagagagaggcgtgattgtgcaggatactgcatgggacggctacgaggagattccggcctggatcatgcagggctacggaaccatggccatggaagctggcgagcagttaaaggaatacggctgtgagcgtccgacccacattttcgtacaggcaggcgtcggttccctggcaggcgcggttgtgggttactactccaacctttacgctgataacccgccaaccttcgttgttgtggaagcggaagcagccgcatgtctctacaagggcgctgctgctggcgacggcgacatccgcatcgtggacggcgacatggaaaccatcatggccggtcttgcatgcggcgagcccaacaccatctcctgggatatcttaaagaaccatgtaaaagtattcatcgctgcccctgactgggtagctgcaaacggcatgcgtatgctgggcgctcccattaagggcgacgcacctgttacatccggtgaatccggcgctgctccattcggcgcactggcagccgtcatgaccatggatgagtacaaggatttgagaaatgacatcggactggacggatcttccaaagtcctgctcttctcaacagaaggcgatacggaccctgaccgttacaagaacattgtatggaaaggtctcgataaataagcaataaagcatcatccaataaacccaatcaccaccgctgccccgcggttcacccccgccgggcggcaccaccacaatatgaatgcaaatgtatatggaggaaatgaaaacaatgagtctggattacgcaaaaatcaaagaagcagcacagaattacgagaaggacatgaccaaattcttacgcgatatcgttaagttcccaggtgagagctgcgatgagaaggcacacatcgaccgcatcgctgaagagatgaggaagcttgacttcaccaaggttgagattgaccccatgggcaacgtacttggctacatgggaaccggcaagaccttaatcggctttgacgcccacatcgatacggttggtatcggcaataagaacaactggaacttcgatccatacgaaggttatgagaacgacaccgagattggcggacgcggcgtgtctgaccagtgcggcggtatcgtaagtgctgtttacggcgctaagatcatgaaggacctgggcctgttaagcgacaagtacacggttctggtaaccggtacggtccaggaagaggactgtgatggtctttgctggcagtatatcatcaatgaagacaaggtacgtcctgacttcgttgtatccacagagcctactgacggcggcatctaccgcggacagaggggacgtatggaaatccgtgttgacgtcaagggtgtttcctgccacggttccgccccagagcgcggcgacaacgcaatctacaagatggccgatatccttcaggatgtacgcgcactgaacgagaatgacgctgctgatgacaaggaagtcaagggccttgtgaagatgttagatgagaaatacaatccagagtggaaggaagccaacttcttaggacgcggcacggttaccacctccgagattttcttcacctccccaagccgctgtgcagttgccgactcctgctccgtatcccttgaccgccgcatgactgccggtgagacatgggagagctgcctggatgagatccgcgcccttcctgctgttaagaaatatggcgatgatgttactgtttccatgtatgagtattcccgtccttcctacaaaggacttacatatccaatcgagtgctacttcccaacctgggtcatcccggaagaccacgaagtcaccaaggccctggaagatgcttacaagaacctgtacggcaatgagcgtatcggtgttgccgctaccgaggaaatgaggaaggcacgtcctctcacagacaagtggaccttctcaaccaacggcgtttccatcatgggacgtaacggtatcccctgcatcggctttggacctggcgcagaggctcaggcccatgcccccaatgagattacctggaagcaggatctggttacatgtgcggctgtttatgcggcactgccgactgtgtattgtaagtaaggaatatcattattttagattattgtccgcagggtgattttttggctgccattcagtgtggttttgccatcccgctggtccgcagtgccatcttcttggcctgtggggcggccaagaagcatagggcatacgccctatgaaaaataaaatataactgcatcctgcttattcgtaaaccattttccatgaagtcctagtgacctgttttatttcggcggcttatgctgaaagccgccgaaggattacaggcccgggcacccagacattgaaaccaaaaaatataaataaatcatattaaaggagttaatcaaatgaaaacattacaggattacattgataagttaagcagcctcaatttcaaggaaatgtacgagaacgacttcttcctgacctgggagaagaccgatgaggaactggaagcagtatggaccgttgccgacgccctgcgctacatgagggagaacaacatttccacaaaggtatttgagagcggccttggcatctccttattccgtgacaactccacacgtacacgtttctccttcgcttccgcatgtaacctgttaggcctggaagtccaggatctggacgagggtaagagccaggttgcccatggtgagactgtccgcgagacagctaacatgatttccttcatggctgatgtcatcggtatccgcgatgatatgtacatcggcaagggcaatgcttacatgcacgaagtggttgacgctgtcacacagggccacaaggacggcatccttgagcagaagccaaccctggttaacttacagtgcgatatcgaccatcccacacagtgtatggctgatatgctgcacatcatccatgagttcggcggcgtagagaacttaaagggcaagaagttagccatgacatgggcttactctccttcctacggcaagccgctctccgttcctcagggcgttgtaggcctgatgacacgtatgggtatggaagttgtcctggctcatccggaaggttatgagatcatgcctgaggttgaggaagttgctaagaagaacgcagcagctaccggcggttccttccgcgtatcccatgacatggctgacgcattcaaggatgctgatatcgtatatccgaagagctgggctccgttcgcagccatggaaaagagaaccaacctgtacgctgaaggcgattccgagggaatcaaggcccttgagaaagaactgctggctcagaacgcagagcacaagggctggtgctgtaccgaagaactgatgaagaccaccaaggacggcaaggccctgtacctgcactgcttacctgctgacatcaacgatgtaagctgcaaggacggcgaggttgaggcatctgtattcgaccgttaccgcgatcccctgtacaaggaagcaagctacaagccatatgtaatcgctgccatgatcatgttagctaagtttgctgatccagctgaaatcttaaagaaactggaagaaaaaggaacaccaagagtattcaaataaatcccaaacctagtcgtagtacattgtaggggctgccggacaacggtcctgcggccctttttgtctccaaaataagttgtattgtgcaaataacaatgcgggataccctcatatcccgcctgtaaaggggaatttcactatggaaaacaagaaaaaacgtattgtcatcgcattgggcggcaacgcacttggcaacacacttcctgagcagatgatagctgttaagattaccgctaaggctatcgtggacctcatcgaagaaggttgcgaagtcatcgtagcccatggaaacggcccgcaggtcggcatgatcaacaatgccatggctgccctgagccgcgaggacgcaaaccagccaaacactcccctctccgtctgtgtggcaatgagccaggcctatatcggctatgaccttcagaatgccctgagagaggaactttacaaccgcgaaatgtacgatatcccggttgctaccatgatcacacaggtgcgtgtggatgcagaagatcctgcattcgacacccccagcaagccaatcggccacttcatgaccgaggaacaggccaagattgcatccgagaaatacggatacatcatgaaggaggacgcaggacgcggttacagacgtgtggttgcttctccaaagccagctgaaattgttgaaatcggcgctatccgctccctggttgactccggtcagctggtcatcgcttgcggaggcggcggaatcccggttacccgtcagggcaatcatttaaagggcgccagcgctgttattgacaaggattttgccagtgagctgttagcagaggaactgaacgctgatttcttaatcatcctcactgcagtagaaaaggtagctatcaacttcggaaaaccggaagaaaagtggttggataatctcacaccggaccaggccaaggtatacatggaagagggacatttcgcccctggctccatgctgccaaaggttcaggccgctgtgaaattcgcagagtccaaagatggacgtactgcactcataaccttgcttgaaaaagcaaaagagggaatccaaggactgaccggaactcaaattcaccaataagcccaaggaggaacttaaatatgaatcaggcaggtaatcaatcagctttatttgactattatggaaaacccagtttttcccaggcgttcccacttgcaatgcagcatgtggtggccgcaatcgtggggtgcgtaacccccgccattatcgtatcaggagcagcagggctcaatcccactgataaagtctttttaatacaggcagcccttgttgtggcaggtttagccacactattacagcttttccccatcggcaataagaacggtcttcatatcggagccgcccttcctgtcatcatgggtgtgagttttgcttatgtccccagcatgcaggccattgcaggccatgaaagcgggctgggggttccgatgatattaggcgcccagattgtaggcggcgtggtggcaatcattgttggtttttccattaagaagatacgcaagctgttcccgccgttaatcgccggtactgttgtgtttaccatcggtctttccttatatcccactgccgtcaactacatggcaggcggagccggcaagcccctggcaagcgaaatcggtaaactgggctttggctcatggcagaactggacaactgcgttgattactttagccgttgtcaccgttttaaatcatttcaccaaaggtatcctgaaactggcctccatccttatcggcgtgattgtgggttatgccgttgccctgggatttgggctggttgacttcagcggcgttgcctcggctggtattttccagttcccgaccccgctgcactttggggtaatatttgatccttcttcctgtattgcaatcggccttttatttgccatcaattcaatccaggcaatcggtgacttttccgcaaccaccaccggctccatggaccgtatgccggaggacaaagaattacagggaggtattgtgggttacggtatctccaatatcataggcgctgtgctgggcgggcttccaaccgccacctacagccagaacgtaggaatcgtagtgaccaccaaggtaatcaaccgcatcgttctcggaatggcggctgtcatcctgctggttgcaggcctgattcccaagttctcagcagtcctgaccaccattccccagtgtgtactgggcggcgctaccatcacagtattcgcatccattgccatgaccggcatcaagttagtcatgacagaggacatgaactaccgcaatacttccatcgtaggcctttccgtagcattaggaatgggcgttacacaggcagccaattccctggcagcattccctgactgggcaaccaccatctttggtaagtcccctgttgtggttgcaacctgtgtggcaatcctgctgaacgtaatccttccaagggataacacggcagcgaaaaagaattaatcctctaattgtatgtaatggtacagctagtttataatgtttggaaatgcctctggcctggattcgcggccggaggcatcttcatgttcccctttttcctattcccaatatccgttttaagcatgtttttgcaattcataacagaatttcaatcatcctgaaaggatacggccttcacaatcgtattatggatgagacactaattaagaaggagattgaaaatcatgaaaatcaggactataatagcaacagcagtaacaggaatcgtattaatggcagcaggcagcagccttgcctttggcgcggactggacgtgtccaaggggctatggggactgtaccagctatgaatactgcaccacccatgaccatggggactgtgacggacactggtctgaggaaggcgactgggtgtgcccggacgggacccacagctatagctgctcctcttccaccgcttcctccccatccgccgcttccggcagcagacgcggtcaccacggtgaacacaggcagggcggtcagggacatcacggcagccatggatgcgggacgggtcgcagataagcatatgccataccagatggagaaacaatgcggcaggaaacagatgtagagcaggcaatcgagcagtatgctgacatgataaagcatatctgccttgtctatatgaaaaatgaaagcgatacagaggacgtgtttcaggatgtgtttttgaaatacgcccttttttctgaaccctttgagtcggaagaacataaaaaagcctggctgattcgtgtggccattaaccggtgcaaggatgtgctccgaagctttttccacaggaatacatgttccctggacgaggccatggccgtggccgcccctgacagcggggacttctcccatgtgctggaggccgtcatccggcttcctgagaagtataagatcctggtgtacctgcactactaccagggatattccgccgtggagattgcaggcatcctgcacaaaaaggtgaataccgtatacacgcatctggcaagggccagggcagaattaaaagacatgctgggaggtgatgaaggtgaaacaggaaatccgtaaggcatttgacgcggtccggtgcgaagacggactgaaggaacggacacgtgaccgtgtaatacgcaggatgggacaaaagcagccaaaacctgccctgcgccggatgagacttgccgtgtccctggcgtgcctgctggtgtttgccggaagcggattcggcggataccagctctactatgcggaggcagccaccatcagtattgatgtgaatcccagcattgaactgggaatcaaccggtggggaagggttgtggaggaagtcccctatggcagggacggtgaaatggtgctgcgccaggtttccctgcggcatctggaatatgaggaagccctcaaccgcctgcttggcagtgaggtcatgcaggactacctgaaaaaagacgccctgctgtccatcacactggagaacaggggcggggacggcattttactggaaaacctccaaagctgtgtggacaccaccctcaaacagtgccacagccaggccaggacagaatatgtcagcgtggacggccacatgtgccaggaagcccacagccttggcatgtccgtggggaaatatcacgccatacaggaacttctcaccgcggacccgcaggccaccctggacgagttcaaggataagtccatgaaggaaatcaagggacatacggagcactgtgggcacaaggcacaggaaacaggggaaaaggaaacaggggaaaaggaaacaggggaaaaggcagccgatggctgccataataaggggcatcacggagggcgggaggactaacagccctcaatcccataaagcctcacggcattcctccagaggatgtcctccttctcttcccctgatatatccagacttcttatgaaatcaggcccgtccgtaagccattccatgcgcacagggtatgaggagccatagatgatatggtctgaaccaagtacccttaccgcgccctcaagcgcttccctgccccatggctgcgcatggctggtctcaaagaacaggttctcagatagataccgctccatctcatccccgttatcctcaaaacgtcttacctcatcctttcccaccgacctggcagggaccatcatgttccggaaggcaaagaagccgccgcccagcatggaatggaccatcttaacatgcgggtatttcccgaacatcccgctcatcatttccctgcacacggccgtcatctggtcggcacagcggccgtaggacctgcggaggttgttatatgccagcagggaaccatggtcaaccggcagcggggtatggtggacgtaaaccgtcatcccgtacgcctccagccgttcaaacaggggggcaaaggcttcatcgtccagatacagctccccataatgggcgctcatctgtacgcccttcattcccagttcctcatggcatcgctccagctccctcaaggacgcctccccgccaaagggaggtatgaccgcaagagggaccagacgcccatggctgcgcacaccgtaatccgccatcccatcattgaaaagcctggccatgtcaaggcccatccattcatggcagcagggtaccttcatgaccgcccggtcaataccggcccggtccatgtccgcaagctgtgtatcaaaatcataatccccctccgcataattcacgcctgggcagcctgcggggcgctcgatgacgatttcctttcttccgtcattgtcccggacccgtcccagggttccataagcccggggaatatctgccaggaacgtttggagcagcctgtcatccttgaacacctgttccgggaaccaatatacatttgcatctattaccatcttacgatacctctttctcttgattcatggcttgcggtttttagcagaaaaccttataatgtttaggaaggtatctcacttttaaccgaattaatacaggagaccatgaatggatattgactatatacatgaattcgttgttctggccgggaccggcaactacatggaagccgcggacaggctgttcctcacccagtcctctctcaccaggcatatacagaagctggaagccgaccttggcgtcacactctttgaccgcaccaccaggcgcattgaactgaatcaatacggcaggctgttccttccctatgcggagcagatagcgctgctgcaaaaggattataccacggccttctgcaacgaactgaaccgtgagcggggcaccatacgcattggcgccattcccgtgatggcccagtaccatatcacggatatccttgcccgtttccagcaggagaaccggaattacatgctggatatccaggaagcggattccctgcagctgatccagatgctccgtgaggaaaggattgactttgcggtcatacgcgaatccgatgacgcatccagctcattcaggaagattcccattacccaggacaccctggcagccctgatgccgaagaaccatcccctggccggcagtggacatattgagctaaagcagctttaccgcgattccttcctgcttcttggaagggacacgttcatgtattccctttgtgtccgtgaatgccgtacggccggctttgagcctcatatcgcatttaccagcaaccgggtggacaatatcatcggactggtaagcaagggcatgggcgtgggactgcttaccaaacggcctgtcatgtcagccaaccactccgacatcgcggtcgtggatgtccttcccgccatcaccaccaccatcagcctggcctatctgcccgataagaagctcacagccccccagcagcagctggtccagctttttgagagcctgtaagtgcacaggctccttttttatcccataaacagcccgccgttaaggcggagtacctgcccggtcatgaatcctgcttcctcgcttgccagataacacaccacagccccaaactcctccggtgtcccattccgtcttaccggtatccgggggaccagcgtccggttgtccagctcgtcttccccttccggcgcatggtcattctccatgccgcccctggcaatacagttaaccgttatgccctggacggccagctccctggccagatacctggtcatggaaatcaccccgcccctggcagcacattctaaaagtccttcctctaaaagcccgttttccgcacctgtaccggacaccaatatgacgcgccccgccctgcttttcttaagataggggattgccttctgcaccatggtaaagcttccggtgatctgatggtggagcttcccgtccagttcctcctccgttatatcggataaatcctgacggcgcgccgccgcgccctggttcggtatgatcacatccactgaactgaatctccggtatacctcaccatagacagccccatccccgtcctcattgctaagggcaatgcatgtcccgggattatcttccacttccgcaatcagccgtcccgcatctgccatgttgtgggttaccatcaccacattcatcccggccgcggtcagcatcctgaccgccccggcccccacatggcccgttgccccggcaatgactgccgtacgtccctttaatgtatacatacccatctccgtcatatgaaccgtccattctggtcaatccacgagtctacaaagtcaaacagcaccttaaccgtatccccgaactgccccggatatgtctccgcctcataagccggggtgaaattatgtccggccccttccacaaagccaagggtcttatccgtgcttcccgcccgctcatatatcacctcggacgccagatattcatagcttcccgtcatccccatgacaagcatgggaacatggattcccggcacattggagggtgggcagcagtagctggaatcccagtcaatcccgtaaacgccgtcttcccccacccggaaatcctccgtggtccggacggcctgggaacgcagatatgtcttgaccgtggtcatgaccccgccgcacctgagggaacctgtattctgctgtcccgggcgcgacaccctgacgctgggcaccacctgcagcgtgatgctgccatccccatgcagcaggggccactccttctttgtatgggacagcaggctgaggtcctggggaaacagtttgttgttaggcgcaatctggttggcgcccggaatcaccataggctcatcatccgagtacgccccccttccctcctcaatatccctgagccggttaacggcatgttcaatcagccggttgccccgttccccctgggccttataaaacctgcgtttaaacccttcgctgtaatgggcgccgtccgggtggaacccatgatccatgttaaataaatccagccccggatcccgtccggcaccccctgactcctccatgacggcaggatccaggctgaagagtgtcatggccccgttgccaaagttggaatccaggaaaaccaccccgtccgcagcaggcagtgtctcaatcagcccgcagggaatcagcttttcaggcccctggaacacctccacgccgttttcagccacgcactggtatgcgctcataagggtggcgccgccgctgtggcccagcagaagtaccttttcaataccgggatagccctttaaaaattccacggcagccttcacattcagcagcttatcgtccagcgttgatttggcatctaccaccgttgcagccaggacgcggtatccccgcctggccagttccggagccggtaaaaatcccagatagctttcatctgaatgcatcagcacaatgccgatctggcttttcctgcccagcagttccggttcatacagcagtcccgtcaccctgtccggcagcggtacaaatgcgattctataattatcagacatataagacctctcttattttcctttttagattaccagggagtacaatccctagagcgtgtttatctccgccacacggcagcaggacacaaaatgacggtcagaaaccatggtcagctgctgcggttccctgcacgcctcctttgcatagggacatctggaataaaacctgcatcccggcttcgggttgatgggcgaggtaatctcccccttcagcggaagccgcttcatgggatggaggatatccgtggacgggattgccgaaagcagcgcctttgtatacggatgcagggtgtgtgcaaacaattccctgctgggcgccttctccaccagctgccccagatacatcacgcatatattgtccgagatatgccgcaccacggaaaggtcgtgtgtgacgaacatataggccaccttgctcttctcctgcaggtccatcagcaggttcagcacctgggcctggatggagacatccagggcgctgaccggctcgtcgcagacaatgaactccgggttcagggccagtgccctggcaatccccacccgctggcggcgtcccccgtccagttcatggggataggagcgtctgagccgctcatccacccccaccaggtccatcaggcggttggcctcatcccgcagttccgccttggaatgaaaccttcccgaatgctccagaggttccatgatggtggattcaatccgcatgcgggggttcaggctggaatagggatcctggaacacaatctgcatctgttcccgcaccctgcgcagttcacccttgcgtacatgggtgatatcctggccatttaacaggatctgcccctccgtggcctcctgcaggcggattatggtgcgccccagggtggatttaccgcatcccgactcccccactaccccaagggtctcacctttttcaatggaaaatgatacatcatccaccgcatggttggttccagcaggcactttgaagtattttttcaaatgttttacttctatcagggacggcatacactaatcctccttatgtttgagaccgcatctgcaaaaatgcccgggtgcaatttctctgaattcaatttcccctttgccgcatccgccctttgcatggggacagcgcggtgcaaatgcgcagccctccggcaggtccgtggggtcaggcggggaacctgcaatgggttttaaccgccttacatctgtattcatgcctggcagtgactggaacaggccaatggtgtatgggtgggacggatggaggaacacggcctctttgctgccatattccaggatctgccccgcatagatcactgccacgtaatcacttgtctccgccaccacccccaggtcatgggtaatcagcagcatggacgtgttatatttacatttcaggtccttaatcagatccagcacctgggcctgtatggtgacgtccagggccgtggttggctcatcggccagcagcaggtccgggctgcaggccagggccatggcaatgacaaccctctgcttcatgccgccggagaactcaaaggggtattccccaaaccgctctgccgggatacctaccatctccagcatattggcggcctcctcttccgcctccttcctggtatagccattgtgcagcagaaggccttccacaatctgttcccccaccgtcatgatggggttcagggccgtcattgggtcctggaagatcatggcgattttctcaccccggattttcagcatttcctcctccggtttttttaacaggtcctcgccctccaggatgatttccccactcctgagcctggcgggcggattgggcaggattccaaggattgccttggcaatggtggtcttgcccgcgcctgtctcccctaccagggccagcgtctcccccttatccatgtcaaaggaaatgccgttgaccgcatgaaccgtcttcctgcctgaggtatagaccacatccaggccgcgcaccgaaagaaatttttctgttttctcattcatttccacaaactctcctttcaactgcgcagcttcgggtccatggcgtcgcgaagcccgtcgccaatcaggttaatggccagcacggtcagcgcaatgacaataccagggaacatgattaaatgcgggtaattcaaaatgtgggtgcgggcatccgccagcatggctccccactccggcgtaggcggctgtacccccaggccgatgtaggaaagggcggcagccatggtgatgttcatgcctatgttcatggtggcgtccacgatgaccggagataccacattgggcagtatatggcggaacatgatgctcaaatgggagcagttgatggattgggccgcctccaggtaatccttggaacgttcggaaagaatctgcccgcggatcagacgcacatcaatgggcacgttgccaatggccagcgccagcacggtattgaaaaatccggcgcccagcacagcggaaatcaggatacacagcagcatgcccggcaggctggaccagatatccagaaaccgcatgatgacagtctctgtcctgcccccgaaataaccggcaatactgcctatgatacatcccatgaccgcgctgaacagtgcggcgcagatgccaagggcaagggaatagcgtccgccgtagagcagacggctgaacaggtcccgtcccattgcatccgtgccgaagatatgtcttcctgagggtgtagcaaacatattggccaggtccatttcattgacgccatagggcgccagcagggatgccgccgcacaggatatggtaatcagggcaagaaggatgacacccacccttgcgcctttatttttccagattcttgcaaatgtctctgcaagcagcgatgatccgcccataccattcattttcatgctttcaccgcctttcgggctttaccgccggaatactgcgccttgatacgcgggtcaatgaatgcgtaaatcagatccactgccagcatgaccagggctgtgaaaaccgcaaagaacaggacgcatgcccggaccaccgggtaatcgcgcatattgatggcgttcagcatgtaaagacccacgccaggcactgaaaaaacactttcaatcacagccgaacctgccactatccttgcaaacccggccccgatggaggtgatgatgggcatcagcgcattgggaagcatgtgctttaataccaccattttctcacgctgtccttttgcccttgcggttgtgatataatcctcccggaacacgcccagcatgctggcccttgtctggcgcgcattgaccgcgattcctcccagggcgctgcagatgatgggcatcacataaaactggggacctccgatgccataggaaggaagccagccaagcctggctgaaaaaagcaggatcatcatcagggccacccagaaatccgggcaggagatgaagatcatggcaattgccatggtaagggagtcctgccatcttccctcgtgggttgccgcgaagattccaaggtacaggcccaggcccaggttcagcaccatggcgcagaccccgattaatatggtccttggaaggcggaccagcatttcctgatagaccggtttatcataaacccaggaattgccgaaatcaaaccggatgaatgtattgtaaaaatagtctccaagctgtaccagatacggcctgtcaatccccatcttagtccgcatgagagcaatgtccgacgcggaggcattgcctccggcaatcacgatagccggatcgccgggggtaaaatagaggattgtgaatatgatgaatgccgtaccaagcacgattacaatcatccagagcagtcttttcaatatatattttcccatatgtctcactccgatttttgaaacctgcctgattcacaggaactgttttcaggaactagtcaaggtaatagtcgcatgccccgggaagcaggaattcactttcacggtaaaccaaggttgcaaaatccttactgtacaccgcgttcatctgcggcatgcacagggcgtggtagtaggcgttttctacaatatagtcatgtaccctggtcatgttttcctcgttgtgcccgtcaaccgtattggcggtcatgaacagctcctgcagttcatcatcatggaggaatgccatgttaaatccggtgccgaactcattatagttgattggacggttccactcccccacctgtgtgccgcctccggggttccagagaaggatgtcccatgcatccggattgttcacatcagactggaccagcgcgctttccttggcattgatttccacattgatcccggcctgtaagagcagggcctgtatcatggtcatgatgctcttgatatcttcccggttaaagccttccagcctcagggtctcgccgttatagccggactgttccagatattccttggccttttggaggtcatatgtattcatataggtttccgtgctctcccacacaggataataatcctcaaagaacggggtgccgaatgccctggctgcaatggatgtgccggtggctgccgcaattgcttgattgtcaagggcatagaagattgcctttctcagattgacatcgctcatcaggttgttttcagagcagttgggaatcagggtatacagttccgaaccctgggtcacatatacgccataccggtccgcatactgtccgccctctgaaaaatccttcaggttctctgccgggacagcctgtgaatactgaatctggtccgtgctcagtgcaatgacgtgctgggatgcctctgcaatgatgtcatactcaatggtctccacattggctttgtggtttgaatcccttaattccgctgtctgccagtatttatcattggcttttaaagtcagatgcgcgccggaaacatattcagacaccacatacggccctgtcccgattggcttgtccgcaaagccgccgatttcctcataggatttctgggaaaccaccatggtacggcaccagggccattccagggcgcccacctgtaccacgggacctgtccatgtgtattccagcgtgtaatcatcaatggccttgacgctgtcaaaaatatcatactttacggcatttcccgaatccaccaaaaggcctgtggagaataccacgtcctgtgccgtgatatgattgcccgcggcatcgtagatgttgtcgtggagggtcacccttgtatgggtttcatccacatcctggtactcctttgccaggatagggatatatccgcctcccctgaaatcaaacagcgcctcataaatattataataaatgtactgcttgctctggtcgcccgcccaggtatacggcgcaaggtcctgggggtcactggacagggcaacggtcaccttcccataccgttcatctgaatccgccgtggtcttcctgctgctgtccgccttgggcgcttctgacgaggcagccggcgcctctgccggtgcagcccctgcctgcgcggcggttccccctgtcccggaagcactgcctcccggactgcctggattgccgcccccgcagcctgccagtgaaaccgccattgcggctgccagcgtcattgccgccacacgcttagccatgtacttaccccattttttttgcattgtcgtacctcccattttttgttacactgttattttgcagacattttgtacaaagtacatatttcaatgtagttttattttagtatatccatggataatgtacaaaccgtatttgaagttgatttatgcagtttgtgcaattatccctggagagcacaaaaaaagcagcctgaggaaacaggccgctttgattgctatactcagatttcagatgccggctcattcccggctgcgttttatccatacttacattacctgtgcaggaacatgtccttctccattacgctgacaataatacccatgcagatcagaacgccgcccacaacaaagttccatgtaaggacctcccccaaaaggaccacccccaatacagcggatgtaaggggctgtagcgggtaaaacatggagcacacgctggcgtccagaagcttaagccccatgttccagagtgtgtgggccaccgcagttcccactacccccaggtaaatgcaggcaaggacagcggacccggtcaatacgggcggtgtttttaccgcttccaccatggcgcacggaaccgtgaagataagggcagcccccagcccgtacagcgcaatctggaccgggtcatatcccccggaaaccttcctgatggccacggaagcagtggaccataagagtacggagcagacagaggccgccagccctgccgcgttcactgacgcgcctcccacccccaggatgatgtatacccccgcaatcgatatgcagatgctggcaatatgccgtttacgtatcttttccttcaggaaaacagctgccagaagggatatggtaatgggattcatgccgttaatcagggaggccagggatgcatccaacagcttggttcctatcagctggaacgtaatggaaacaaaatatcccagcccgcctacaatccatatgtatttccagtcccccttctgtacggtgcgccttgtctttctcatgtgcaaaagcacggtaaggcacgcgcccgccaccagataccggaaacacagcacggtaagaggccccatggacgccagggcgtatttgcttgctatgtaaacacttccccatataaaacatgtaattatgacatataagtagccgatacggtttttcatttcacgctctccttttccccgtcatcctgtccggagccaacaactgcaatcataatatatctgccggaaaatatcaatatggaatttccgattatgtgccattatgggccgggccggggaaccaggaaaacggcgccgggaaaataaatctcccggcgccgtcccatgaccatgcttattggattgtaaagtccactgttacctgcgcctccacgcttacttcccccggcatcacagccatgtcagccgctgccgcggttcccgccgccttgcctggaccggaactgttataggatgcatatcttgcatttggattgtatccgtattcctccacatgggaaacgctgccaacggtcttgccgctagcctctgccagcgcatctgccttggccctggccactgccatggctccctttaacgcctcctggtagcttgcgtcatagctgctggaaaagtatgtaacggaatcaattccattgacgcctgccgacactgactctgccaggatggttcccgcctggtcgatggggatatccgaaaccgtcagccttgtggtcatctcatatcctgtaaccgcctggtcagatgagttccagtcatggatggggttcagcccataggatgaggtctggatggatttctcctccaccccaagggatttcagcttctcaatggctgcatccagattctttgcattctctgactggcactcggcagccgtgtccttcttggtatagatggaatattcaatttccgccatgtccggtaccaccttcacctcttccttgccgatgacggtgattgtattgcttgccgcgtccacgttctgcaccttgatggtgtccggtatctgtgtccctgtgccgcagcctcccagccccaacgccgccgctgccactgctgcggacaggcctgctgtatagatggtcctcttcatgtttatcttcattataaatgcctcccttcttccatgccatggaagatattttttctacatccttatattaccagaaacatccggccatggtatttcttttctcttaaataataggttttatttgtttacgaagtttctacgaaattattgctcctggcatatttgtgttttcatatcaatctgtgttatatttatgaaggtgatggaacatcataggaaggcgatggaacatcataggaagagaacaggaaaggcggaatacgcaatggaaacatttaagaactgcaagctggagattttcatcccccagtcccatctgtccgcgctgcagaaagcgcttcaggcagtggacgccggacatatcggacaatatgacagctgtatgtcatacagccctgtgacaggctgctggcggccgttacagggaagtacgccctatatcggcaatatgggggagctgagtacggaaccggagatgaaggtggaagtgacctgcccggctgaaaaggtaaaggaaacacttagggccattaaaaatgtccatccctatgaagagccggtcatcaatgtaatccctctgtacatgaccggtatggatgtatgaaacagaatcccaacaaaaaagacaatgccggaaacacttatactaaggattacccggcattgtccagcgtgtagcagataaagcaaaatccgaacccctgttaaagagttcggatttaagcttatcgagtggagctgaggggaatcgaacccctgtccgaaaaccaattccctgttcttctactatcatagtcccttatttgacattccctctgccatcagagaaaggacacccggatggtttcagtagcttcatcatacgcccatatgctcaaagctttgcataagtcgtttcccacatagtcgatgccagggtcttaaagtgcgggtgctctaagtctgacagctgccattaggcagcgattgctaattcgtcgttagcgtttatatttatttttgccatttaacccatcgcatggggatagcttcaccagctgcatgacccccgtcgaaaccagtacaacccctgaatgatcagtgttccatgtgtctggtatgctaacgaatcctgcgctttctacataatagcagtttccccgtccgttgtcaagggtggagtttggaagaaggacgcatgggctggaaccggacaggaacctcattccctgatttaaatgcctgcgcttagtcatacacccctgattcagcaaaaaaataatggcgttccgtttccccaaagaacttatcataaaacgcacccgcaaatagtgaacagacccatttcgtgcccgccatttcctgctccagccgtttttttccggactcaggggcatttcccggcatccaccataacagctccttctgaaatgcttccacgtccttatccttaatatggaaccagcggtttttaagcccaaaatagtcatcaatccaataaccgcgcagcgcggcaatccactcagcatccggcatccgcctcaccacctgctggtccggcgaggtccgctcctgctcactgcatatccagtcattctggtagtacaggtccagaatgaaaagcacggaaaatgcttcctgccagccttccaccagcggcttttccacgccaataaaggaaactcccagcggatattggaaaaagtcatggatttccccatcatatttcctgatatcaatggctgccgcatttatagccagcctttctttgtcctgtgttaaccaatccagctgtttaaccagattccccattttcccaccttatattcccttatatttaaaaaacccccaggcccagcaactgcaggaccagcagccccagaagaaaggaaacggcattggccgccgccgtatacttcagtatggactgctttggaaaccttccccccatgaagcgcagataaatccggtattctgccgccagcacaaggatttcaaacacacacatcacgggaaaataatatcccctgagatacagacggaaggtgaaatccagataccctaataaaacattcataatcaggttggtgccaatattcgtaaggaaaatcacccgttttggcccaacacccatgatggccccggctgctgtttcaatccccgcattaaaaagcacggtcagaaccagcatgatggctgttcctgcaaaatattccctgtaatgaacaggggccggagaattggcatacacctgaatcattccagcttccatgaaaagcattgccataagacaggattttcccgcacagtccttcttcaaattcattcctccctgtacctagtataatactccaacccattttattgatcattacatgccatacagccccggtcatctgctccaaatcacggatccggctgataataatatcttcattgggtccataatccagcgtatcccagccaatcttctccctcacgcccttcaggacctgtcatatccctcccggtatccggggtattaagtatcctattggtaaaatgcacaaaacaaattttcataatcgataaagtttgtgcagacttttttcataccatatgctattataattaatgtaaacccccccaatacattatatagtttttgctacaccccataagaaacgaaataccttctcctaaaatgaccggttccccgaccggtcatttttcattgtgtttaatctggttttaatgctgcccctcctgactataaagaacattttatcacatcctctttgattttcctaccatattccataatacaggctggaatccgtcgccggatatccggcttatattaatatgcttccggcggctccgttaccatatcctccccatattcaaactctgccttataaaactccctgccctggtccatatcatattcattatggtagcaccatatgaccagacggtccggcgtgccgttcatttgattgtactggattacaatcttttcaacggtttcccccactccccatggcctgttgatgattacatacagctctgtttccctgtaatccatacctgaataggaaaatgaccggcagatcctgtattccgggctccaggttttatatgccaggaaaatcagggcagccattattaataacgcagcgagatatattgtacactttttcattcctaattcctccagtatttatagaacggatgaacagcgcaataatccccctcctgtttttttcttccattgttttcatcgcgcggatgtcgaaaattgtcaattgaggtctgattctttacccccaatataaaaaaggcccggccgatatggatataccggccaggtgcctgattttaaataatatataaatgatttgagataaagagaaatgacggcttttttcttttgcagccatgcggcggtatacgggattatttcatcttagcccttcttttcctctatatattttagggcggcataatagagaataattaaggctgatgagagtaaaatgcctgccacgatatcagtaaaccaatgaactcccgatataagtcttcctactaccgttactgcaacaatcaaaacagaagctatatccattatccatagacaaactttcctgtcacgtaaataataatgaaactgcaacattgctgtgaccataatacagattacaatcattgcatgagaggacggaaaagatgcttctaaactttgggagagaatgaccggtctataattgatgattacaacttcaaagaaaacataaaatacaatgacaataaaataaaatgcaccaagcaatagaatgcgtgaatcaactttccaaatgcttttacgacgtatgagttggatcagtcctaggattgcaaaccccaaagcaattactatggcaacaacacccagccagtcagtaatgctataccaaagcaggttcaccccaaaaaggttaaatacaaactgattaagagtagcaagtcctatcatagactgctccggtccgacaggctgtacatcaagtgtcttaatcataacagtaaaaagcataaaaatcagaaacagaattcctgtcatgatgatacatttttttgatttcttttgcatagtatacattcctttctttttgccgtgataaattatgtgtaagctcactttgattatccatccacgcggcccaaagtacaagaaacctgccgtcacaacagaaaaaagctccgtcacttatcgtgtcagagcctgtttttaaggaatttatgactatttttattttctcctgctttgctgtagcaataaaaatatctttactgcaaaaaacaaaaatagcagtatggttacatacggttctcttgcggcagcaaataaacagattgctgccgcccctgttgccacagaaacttttgagataatgccacacaaatgctctttatcaaaagaaataaaagcaagtctggcaatcccaagcccaattataagtaaatagatagcccaatgtattccaatatctatatttgataaatgagtaattgacagaagatttacatgataaaaatggctgccttgaagttccccatagattggtaatacaataagcgcaactgccaatacatctactattccgctgataatgtcataaatccttttaacattcgcgttgttttcggtttctgcaagggtaattagttcttcacccgatagcagctcatctatggttatggaaaaaaatttggaaatacacttgagtgactcaatgttagggtagcctttgccgccttcccattttgaaattgctgtccgtgatacatataattgctctgcaagctgttcctgcgttagatttttcccaatcctaagctggcgcagcttttcgttaaactccatgattgtcctccttgcatcctgcctttttcattccttaatccgccttcatcggaatattaagggtcatatccccgctgttcatcctgccgtatccatccgtcagcagccggacaatcctttttgtgctaatggaatagtcaggattctttattctgaatccatttccatccgtcaatatctctccgccaatgctcaggctttgaattgtctcctccaccgcagtcttgtaacgcgataggatgaccgttttatatttactgtcatattggcccatataccatctgaaatctaccaggcatactgcatatccgccctgggcagcacttccggatatacgctgcaatacgttcagggcatcatcgaggcggcggccctctgcttccagcgcttcgaagatggggtatacacggtcacggtcctcctccgtcccgctgtcttcgacatagtattcaaggctgcttaaaaggacggatacatttaacaggttcaaataggcagagtccaggtattccctctttatttcattacggcgcatataacaggtaatattcatgaaaatggatatcagcaggacaataaccactgccagctgcagtctgttcctcttcataagaacccccctttgcttattcaatgccacatatcatcaccgctcattccccttaccttccatttccattttatcatgcctcccacggtcccgccaccagtttccctccttaaatatataaagtccgttcaataaacgcttgacaggaaaaaactcccatgctattatcaactaaacctatagaaacagtaggaatggaatggaggataaatcatgggagaaaaacttagaagagagaacagacagttcaggtttgagacaacacagcttcatgcaggacaggaacatccggatacggctaccggttccagggcggttccgatttaccagacatcttcctatgtgtttgatgactgcgaccatgcccaggcccgctttaacctcagcgatgcaggcaatatctacagcaggctgaccaatcctaccctagatgtgtttgaggccaggatggctgccctggaaggcggagtggcggccctggcaaccgcctcgggcgcagcggccctggcctataccttccagaacctgacccgctccggcgaccatattgtggcatccagccatatctatggcggcacctataattatctggcacatacatttcccgaatacggggtggaaaccacatttgtggatccggccaatctgaaggcattggaggaggctgtcaaagacaatacaaaagccatcttcatagaaacccttggcaatcccaactcggacattgcggatatagaatccattgcggacattgcacaccgccaccagatcccgctggtgattgacaacaccttcgcaaccccttatctggtccgccccattgagtatggcgctgatatcgtggtccattcagccaccaaattcataggcggacatggaaccacggtaggcggggtgattgtggacggaggacactttgactgggttgcttccgggaaattccccgggcttacgcagctcaatgcaagctaccacggcatccgctttgcgcaggatgtgggcgccgctgcatttgtcacccgcatcagggccatccttttaagggacacaggcgcaaccctctcccccttccacggattcatgttcctccaggggctggaaaccctgtccctcagggttgaacgccatgtggaaaatgcactggaagtggttgattacctgaaaaaccatcccctggtggaagcagtccatcatccggccgtgagccaggatcccggacagcaggcgctgtaccggaagtatttccccaatggaggcggctccatcttcacctttgaaatcaagggcggcgctgggcaggccaggaaattcatcgacagcctggagctgttttccctgctggccaatgtggctgacgtgaagtccctggtcatccatcctgcttccaccacacactcccagttaaatgaggccgagcttctggaacagggtatccggccgggaaccatccgtctgtccatcggtaccgaacacattgacgatatcctggaggacctggaggaagcgttcaactccatcgtatgaatactgcatgacgtacaactgaatccgccggacgggccgcaaaaccggaaacagttttgcggcccatatgccggatttatccgtatttacaaattaaatcaaagaatcctctaccaagcatcaccggcaccttcccacaacaatgacctcatactcacttaatgcctttgtaatccatcctgcaaatccaatgtagaaatcaaacgccgtatcatcaaaccgtatattacccatgtcgcgttccatctcctgaatcaggctgttccactggtccctgtccatccggttatcctgacaggcatcaaaccctggacgcacatgctccagatagggaagcagcagcttcacataatctgtccggaacacggtcagtgtatctgcgcacgtatcataccagccctccggcccgatatctgcattacatggataaaatgtcagtgtggtggtttcatccggcaatgagaaacattttagtaccatgctgtatcccccttttcttccatcccgatgataatcaggtcaatggaaggcatcttctccttctattatactccatcccttaacgccggacaataaaaatcccctcctctatccttctattttcccacattcagtgatggttcccatatccgggaacttaagtgcccccttttcatctgtctcaaggcatacgcagccctcaaacatgcttccgtcctctttcaggcggtagagttcatgtttccagataacccactggtcctttgccatggctccatttccctgaaggtaataccattttccatccgagcctgtcttccagtcattgtgcaccatcatgcctgcagcgtcaaaccaataccagtaatccccatccttataccagtcattggccacatagtccccggtattgcccagatagaacctccatcccccgttttcttccacccagcctgatttcttaaccggttctgttatgccgtaatacagggcaatggtatcggcctgggcgctggccagacgttcaaggttggcatcatttaacagccacttcacaacctcaccattggtatggaaggaattctccaggatcagccccggcgtccccacggccgttgccccgcgcagtacgccatagtaatcgccattgcttcccctgcggtgttcaatgcgcgcaggctggcctgttccgatgaccgtctccacacactgtgccagggccatcccgattccatccgcactcccgttaatggcgcagtatgccgcaggataatccactgtattgttaacagagtcccccactgcattggtatggtccgatataaacaggtcgcatcccctggaggtagctcccctgtcatataaacctctgtccgtgtccttgtcttccctggtagtgattacctcgattccataggcttccaggtattttttctgaagcagatgcagcttccatacgatttccgactcataataacgcttgtctgccgggctttgattatatcttccataatggcctgcgtctaaacatatcttcatactatgatcacatctcctttctgctatggtatataatacgcaggaattccaggattgtcccaaaggggaggaggagtgcatgggtatgcatgggaatgaccgggatactgtatccacaggtcagggcaaaggacggacagaacgccgggttctctgtgccgggaacacacaaagcggaaggccggggcggaaacctctgctccgtcccggccttcactgcccgcttacgcctacgggtaaaagaacctggtcttctgtaccgtgcctatcggcctatgctttccaaaggccgtgaagattacagtatgcataaactgcctcaaccccgtcgccctgacagaccatgaattctgcctggggcttctggcccggcttcagttcctttctctggttgccctgtgtggtggcaagggcaatccactggatatagtgctcaggtgtcatgggatgctctgccgccccaacggtaaccgtaaccttctgtccgtccaccgtaaccaccggaacatgcttttcaacggctgcatccgttgtgttggcaaccagctcctgcatcttttcaccgcagcacatgaccggtaccccgctgctctttacgtacgcaataatattgccgcaatgactgcaaatataaaatttcatgtttctgctccttcctttatgtattttattatatattctaagtctatcacattgattacaatttacaatgccatatgtacatatttatgataaatgtcatgttttttactgcttcatgtccatttccaggcactggaacggcagacggtttccctcatgtccacccattttgcagatctggcggtttgcctccagacagtgtatgggctggaagagccggtctttactgatgagggccggaaggctccacagataatcatccatccggttcagactggccactggccggcgcccatgggtccttgtcagggtgactggcccggccttgtccagatattcctgtatctgaagcccggaatacccctctgcttccaacatcatcctcacgccttccacaaacagcgctgtaaaatccctccacccggcagcatccatgccgcacaggaccacggctgcacggttgctggcattgaccgcaaccagggtatcttctgcctgcagacggatacggtggacctcccagcagtaaaacagcttctgttccgtcccgtattccaggttccttatattcaaatgcttctgtaaaggtatggtaatccccagctccatggccctatcctcctgttcctgcgatgaatttcccttattcacaaactccttacactctgttcataattttgttacagaatgataaaattctcctcatattttaccgatatactaaatattgtaaagagttaatgctaataaaactttttttcataatactcggccggtaaagatgatttaccggcctcctcctttatctacggcttttccgattcttttcccggatgcaccagtgcccctttcccccgtatcagcatatgataaacaaaaaaggatttttccttatgaattacgaacatcttacccctgtcatggggaccatcaccgacattaccgcttataatgatgactgctgcagccagttcgtcaccctcagcgtggacggacagcagattaatatcatcatgacccatgatacctttgttgtggataccatgcgcctgttcccgggaatgcgcatcgctgctttctatgacagcacccagcctgttcccctcatctatccgccccagtaccgcgctgacctgattgcagtgctgcggcctgaagaggatgtggccatcggttactttgatgacagccttactgccattgataattccttaaggctgaacctgtaccagtccaccattatttccaccatgaacggccaggcctacctgtgttcgcctgccaaccattaccttctggtttattacacggccaccacaagaagcattcccccgcagacagcccctggacgcatcatcgtgctgtgccaggccacttgaggcatatcccgatgttactttgcaggtcctgatgcccagtatatatagattatggaaatgaacagcaggatacactacgttgaaaatgatgaggcttaccagacacttccggtaagtctcacatataaatgtcggaaaatgagtatacggctggcacatttcccatgtcactgtaataatgcatataaactttttttgaaatagtaaatctttgtgcacactttttttatcacctatgctattataattaacgtaaacccccccaatacattatatagtttttgctacaccccataagaaacgaaataccttctcctgaaaagaccagttccccgactggtcttttcactttccaggattggtaaattccatcggataattccgttggaaaactccatcagataattttttaatttttttcaaaaaatactggacaaattaaaaactctatggtattataaacaagctgtcgctgatgagtacagcagacaacctaaggcctgatggtcaagcggctaagacgacgccctctcacggcgtaaacccgggttcgattcccggtcaggtcataagaaaagcaagcagatgatgcttgcttttttcttatccaaaaccgtccggaaaacggatccataacatccttagggttccttcatccgttcccttgtctccttgtcaaccagctcccgaagctttgtcagcctgccgtccagcccgtaatattcctttccgtaagaaaggttaaagccatagtcaaaatccggcggattctctccctggctgtgctgcaggatggtttccgccttgtccatggcctttacgaacctggcttccggcgtccttgcctggttatactcctcacacaggctaatgatttcctctgcgcaggcccctggaaggccggcaaccgcttttgccacatccctctgttcctggtcatgctttttccctgcatccggccggagcgccgcggaaacatccccgctgtacagttccccaaggtcatggaccaggcacatgagcatcaccttttccctgtcaagttcaggaaattcatggcagagcactgccgcgccaagggccaggcgccaggagtgctctgccgtgctctcctggcgtcctgaaacagtccatgctgtcctcagcgtggatttaagcccttccacttcctttatgaaatccagatattccttcatgttttgccgtccctgtcctaataaaggtttttcaccttaaaatccttttccagttcccttctctggtccttcttggcaatatccgccctcttgtcataaagctttttaccgcgggccagcccaatctgaaccttaaccaggcttcccttaaaatacacctgaaggggaaccagggtataacccttctgcgcaatcttgccgcccagcttcatgatctcatacttgtgaagcaggagccttcgggtacgcagcgggtccttattgaatatattgcccttctcataggggctgatgtgcatgccgcagacatacacctctcccttgtcaatcttgacaaacgcttccttgacgctgcatttgcccatacggatggactttacctcggtgccgaaaagttcgattccggcctcgtatttctcatcaatgaaataatcatagtatgccttcttattattggctaccagcttaatactttccttccccatgcgtctattcccctttctcgtccgccgtatgcttctcccagtcctttgccaggattaagtcaacggttcttaaaagcctgtccgtggaggacacggtcacccttatgggctgtcccagcttataggtctttttcgtcatctcccctatgagttcatagtgctgttcatcaaatatataataatcgtcatccaggtcgctcatgcgcaccaggccctccacggtgttgggaagctccacatacagaccccagttggtaacaccggatatggctccgtcaaaatcctgtccgatgaaccgtgacatgtattcgcatttcttcagtttatccgtctcccgctccgcttcatccgccctgcgttccagggcagaggtctgcaccgccacttccggcaggattttctcataatgtcctgccctcttatcgcttaatcctcccttcagcgtctccttgatgatcctgtggatctgaaggtcaggatagcgcctgataggagaggtgaaatgtgtatagtacctggtagccaggccaaaatgcccggaacactgggtggtgtactttgcctgtttcatggaacgcagggtcagtctggagagcagcgcctcctccggcgtgccttctatcttatccagcagcttctgaagctccttggggtggatttccccgtgctgcatcttaatgaagtagccaaaattgttgatgaatgtccccagctgtttcatcttttccggatccgggttgtcatggctcctgtaaaggaacgggatggactgccagtaataatcctcggccacggtttcattggctaacagcatgaaatcctcgatgatcctggtggccgcgttgcgctcatagggcttaatctccaggggctttccctgtccatccagaacaatcttgctctccgggaaatcaaagtcaatggctccccgcttcctgcggctctccctgagaatatccgccagctccttcatgcagtcaaacatggggacgaaatcctcatattccgccatcacagcctcatcccggtccgtcacaatggcattgaccgcggtataggtcatgcgccggtccacatggatcactgtctcggcaatccggtggtccagcacggtaccctgaccatccacctccatgatgcagcttaaggccagccggtccgtgcctgcgttcagggaacatatgccgttggacagcttgtgcggcagcatgggtatgacccggtccaccagatagacgctggtgctacgcttgaacgcctcccggtcaagggggcttccttccttcacataatggctcacatccgcaatatggacccccaggatataatgtccctgattgtccctgcatatggtcaccgcgtcatccagatccttggcatcctcgccgtcaatggtcacggtctgaagcccccgcaggtcaaggcgtcccgaaagctccccgccccatccatcgtgggacgaaaggtcactgatgccataagggctgcccggctttgccggctggcctggaatgcctggctgggccggaacatccggctggcctggaacatccggctggcctggaatatctggctggcccggtatcaccggctggcctggaaccgtcacatcctccgggatgtcctctatctcctccatcacctcctggggaaatgcctcaggcagcccataggccctgacaatggacaggatatccgtgcccgggtcgttgacatgtccgatgatttccgtgacacgcccctccggcttatgtttctcactgccaaagtccgtaatcttcacaaccaccttgtgtccggtcactgctcccatatcgcagccctgggggatgaagatatcctttgccagcttctggttgtccggtatgacaaaaccaaagttcttattcttctggtaatagcccactatctcctggttggcatgttccaggacccggatgacagcgccctctgccctgcgtccgcccgaacccatgccggaacggctgccggacatcctgctgtcatgttccaccacaatctgcacccggtccccatgaagggctgcccctgtcttatcctccggtatgaacacatcctgttccatcccctccactgtcacaaacccaaagcccttgggatgcccggaaaatataccgtttacggaaaatgtctcagcctttccatatttccctttcttggaaacaccaatcctgccttctgccaccagggcattaaggacctccatcagatcctccctctgtgatttgggaatgttcaaaaggatggccagttccttggccttcatgggcacataggccttgtcatccattaattccgtcaatatctgcttgcgctgttccaataattctttttccatataccctcttttccgcctaaagaaataaaacacccttatatgaatacaagggtgttttggtcacgttcacttcttttctcttattatcccgcaatcttcagaagaatattcaggataatggtaataatcataaatacaatcgcgccgtatcttgtaaaatgctccagggcgccctccatggaacggcctctgttcttgctccagtaactgtctgtggagataccgccgattgcacttccaagtccgttggacttaccttcctgcatcaggataacgattgatatggcaacaccaaggattacatatatgattgataatataacctgtataactgacatccgcctgcacctcttcattttcttatagtcaaacacagatatcttatcacactttgtccgaaaaaacaacctgttttcccatttttacacagcttttatgccctttcatgccgtgtcactgatatatggaaatagtgtgtgacagccaatcggccgtcttccccaaggctacatggcctgggatgtgataaaggacagattcccctggaacctgacggtcccgtatccggcaggtacaatgaaatggcatccctttttcactgcggtgccgtccaccgtgccttcgccttccaggatgctcacattggcaaacctgtccccgaagtcctcctcccactcacctgccatatccaccttgtcagcggtataatagcagcaggtaatcaggtggtacttcttaccgttgtccgtttccttcacaagcactggctgctcatcctcacgctgcacaaagggcgcttctatcacgtcaatgctctgctgcacatgcagctgccttggcctgccctcagaaagcctgtcatagtcatagacccggtatgtaatgtcactgctctgctgtgtctccaggattaaagtccctcccttgattgcatggacgcacccggggttaatctggaagaaatcacctttcttaatgggtacctcccggatgaactccgtccacctgccctgttcaatcatggacctcagttcttccttatcctttgcatggtggccgatgacaatggtcccgtcctcatcacagtccaggatataccagcattccatcttcccaagggaaccgttctcatgttccgccgcatatgcattgtccgggtggacctggatgcttaaatcatcccttgcatcgatgatcttcaccagcagcgggaattccccgcaggaatcagccacggtcccaaacagttccttatgctccctccataatgaacttaaggtatgtcccgcatatgtaccggatgacaccctgcaatcaccgcttctgtgtgcgctgatagcccagcactcccctgtgtgcccgcttgggatatcatagccatacacttccttcaggcggcttccgccccagattgcttccttaaataccggttccatcattaacagttctttcattcccttatctcccatccttactgcattatttatatttcaatattgccttatttcatcatacataaaaatggggggttgtcaagatttactgttgaagtagctgaaaataaacagcatatacccggctgtcccgggaaaggacagccggatgctgcatatccgtatttattcagcagacaggttgaggttctcctcaatgcggagcagctggttgtatttagccacacggtctgagcggcagggcgcccctgtcttaatctgtcccgcgttcacagctaccgcgatatcggcaatgatggaatcctctgtttcaccggagcggtgggagataatggtcccgaatccggcccgctttgccatctcaatggcttcaaagctttccgtcagcgtgccgatctggttgacctttacaaggattgcattgcccgcctccaggtcaatgccctttttcagccgtttcgtgttggtcacgaacagatcgtcccccaccagctggatgcggtttcccagctgttctgtgagcattttccaaccatcccagtcttcttcctcaagtccgtcctcaatggagcagatggggaaacggtccaccagccccctgtaatattccaccatctccccggcgctgcgctgcacctgtctgcccgccatccggctctcgcccgggaacaggtacaggccggtggcttcatcgtaaagctcactggacgccgcatcaatggcaatcttcatatctgaaccaggcttcaggccgttcttctccatggcctttacaagatactccagcacctcctctgagttcttaaggtcaggggcaaaaccgccttcatcgcccacacccgtgctgtatccgtcttcctttaaaagctttttcagggtatggtatacctccgcacacatccttaatccttctgaaaagcagcatgcgccgtatggcatgatcatgaattcctgaaggtccaccgtattgtccgcgtgctttcctccgtttaggatgttcatcatggggatgggaagctttgaggcgtggatcccgcccaggtacctgtataaaggcatatgaagcccattggccgctgccctggccactgccatggacaccccaaggattgcgttggctcccagctttgccttattctcagtcccgtccgcctctatcagcagatggtcaatatacctctggtccaggacgctttcaaaaagcactgcctcgctgagcactgaattcacatgctccactgcctttttcacaccctgcccattatagcgctccccgccgtcccttaattccacggcctcaaacttaccagtggacgcgcctgacggaacggcagcgcgtccgcttgccccgcccgtaaggcagacctccacctccacggtcggattccctctggaatccagtatctcacggcccgtgaccgcctctatctccaactcattcaacataaaaaatgacctcctcatatcaatctctcaatgatataaggatagccattttttagcattttatgtatgaaaatcttaattgagccgcgccccgtccgcacctaccgtatatccgtccggcgtgaccgtgcccgccagcatggccccgctgtcatcgcagtaataaaacttatcattccactggatccagccggtcttcatatagccttccccgtcaaaaaagtaccacttcccgcggatagactgccagccatccttcgtatagcttccgtccggattcacataccaccatcccctgtcatcccgcatccactgtccgttcagcctggcaaggtcttcctccgtcacatccatataggtggattcctgccagtccccagcattgctgcggctgtcaacggcccttaccttaaagtaataggttccggtcctggggaacctgcctgaaaaatcaaagctgttctccttcaccgtatacacgtttccaatcccgtcatccgaggttgtggaattattgccatagcggcacagacgcaccttgtagttcttagccaggctgttatggtcccagtgtgcaatgccgttgtactcatcccaggtaagcccgctgacatccaggtcctcatcatcctcgtccagcttttccagggtaacggtaagcaccatctcagacttgtcagacttggtggagcttgtcacatacttcaccttgtccccgctgaaggaaaatgcactcttgcctgactttgcaaagtaataatcggaatcagcagacagccacacctccaccttcggcttgtccccgcccacccagaaatccttttcattaacaatatccacactctcaacggagcagttgccgctgcccagagtgacatccacatcgcctccggactctcctgcctggatatcataagaaaacgacagttcaatggtgccgaccttctcacgctcctcttttgccaggcttaccatggatatggatgcagcaacggccagggacagccccagcgtgatgacccattcccgctttcttcccataagaaactcctcctttgaattattctcacttcatcatatcacaaaaccatgataatttgaatctcatttccagaccttgggtcttatttttcctgggtcttattttgccctgcaccttattttgtccggattcctgccataagacagaggacggaaatgaatttaaatactgcccctggacagcgctggtgccgcatacaccaaacttgttctattttcatatagtactaataagccggcaagccccatggccccggcccctaaaacagtttgacgcagggggattaccgcttgattacattaagtctatgcatgattgtgaaaaatgaagaggcagtgctggaacgtatcctgaaacccatgtccctggccgcagaccagattatcattatggacaccggctccacggacaggaccagggagattgccagacgttatacacaagaggtctatgattatccctggaaggatgattttgccgctgccaggaatgctgcctgcgaaaaggctgtcatggattactggatgtggctggatgcagatgataccgtcagccctgaaacagtaaggaagcttataaaactgaaggaagaactggatccatccacggatgtggtaatgatgaagtatgccactggctttgattccaagggcaggacaacattttcctactacagggaaaggcttttaaaaaatcatcatggtttcacctggcggggacgtgtccatgaggccgttaccccaacggggcagattatatacacggatattgaaatccggcataaaaaggagggagaaggggacaaagaccgcaacctcaggatttatgaggccatgcttaaggacggggaagcgctggaacccaggcatcagttctactatgccagggaactctactaccatgggtgctatgaggatgccatccaggcgctggagggctttttgaaagagccggaagcatggattgagaataagattgatgcctgtctgcatctggcctactgtcatgaaaaactgggcaggcaagaagacgccatgaaggccctgactgaaagttttgcctatgacaagccccgcggggaagcctgctgtgagcttggaaaactaaaaatggacaccgggaaactatcagaagcagtttactggtacgaacaggccctctctttggatccggatgaacaatccggggcctttgtccagaaagactgctatgggtaccttccttccatccagctgtgcgtatgccatgacaggctgggtgaccataaacgggcatactattatcaccagaaatcacagaaattcaagccggacagcgaggcagtaaagctgaaccaggcatattttgaacggatattgaaacaaatagcggaggcagtgcctcccaaacagtaaacaaggagatgttgctatgtattttaattttccaaatggaatgaatcaatataatgacggcgatatggacggccgcggagaatccatgaacatgggccagcgccggccaggctgcggaggcgggtttcctcctattccctgtcctcccccggatttaggatgcggatgccctagaagagggcccaccggacccatgggaccaaccgggcctgcgggacccatgggaccgcggggatgccctggagtacagggaccaaccggccccactggcgccatgggaccgcagggatatgttggaccgaccggggccacaggagccaggggaccacagggatatatcggggcaaccgggccggccggacctcagggactgcaaggcgtccagggacctgccggaccacgcggcgctaccggagccacaggacttcagggactgcagggtatccaggggccaaccggtgttaccggtatacagggaatccagggaccgcagggtatccagggacctgccggcgccagaggagcgacaggcgctaccggcgctaccggtgtacagggtctacagggtctccgagggcctaccggggcaaccggcacaacaggagccagccctgtcatcactgtagcaggaaccgtcacaggcgagcctggctcacaggcagctgtagatgaaacctttacccccaacggggcacagcttctgttcaccataccggcaggcgccactggggtccagggacccataggaccaactgggccgactgggccgaccggacctattgggccgaccggatctactggccctgccggaacatccggaccaaccggagttgcagaaacgattacaattcgcaataccaccacaggtacacctggatcatccgccgcagttgtggatgtgaccggcagccctgaccatgtgctggattttatcattcccgcaggggtaaatggggctactggggctactggagccactggcgttaccgggcctgctggaccgactggagctgccggtgttaccgggcctaccgggcccactggtgctgacggcgttactggagcgactggacccactggcgctactggtgccaatggtgttaccgggcctaccggacccactggcgctgacggtgttaccggacctaccgggcccactggtgctgacggtgttaccgggcctaccgggcccactggcgctaatggcgttaccgggcctaccgggcccactggtgctgacggcgttaccgggcctactgggcctaccgggcccactggtgctgatggtgttaccggaccgaccggaccgaccataataagaaaacggctatatatccattgtaacagcaaaaataaaatacgagcttatcactttaccggacaagcgccgcccaagtagagactacgggtggtgttttccgttgtgaggcgggaaggaggacaattcccatgcttcgggccaacatgatatgctccctataagagagacaatgaaaaacaaaacaagggagcaactatgggaaagcgaatagagatggatttagaagaaaaagtgtttctggtaaaggaatacatagagggtcgaatcaaaggccgggaagcagcccgtcgggccggaataggatcttcaacgatgcaaagctggatcagccgttaccgggcggaagggatcgaggggctccgtcaggatggaaacaaggataagcgaaggtacgacaaacagaccagacgaaaagtggctgaggaatatctatccggcaagggtagctccctgaccatcgcagaaaagtataaacttcgctcaggaaacttggtattagattgggttaaggagtatcatcgtcataacagaaaagaaacaggaggagatgttatggcgaagaacagatacacattagaggaacgggtacaagtcgtgaaagagcatctggagaatggaaaaagcttttcagagattgccaattcctataacttgagcactcagttggtccgtacctgggtgaaaaaataccgggaaatgggtctggcagggctggaggaccggcgggggaagcgtacggcagagcaaataccccggacgccgcatgtccggtgctgcacaagatttacctcagtgccatattgaatttctgcgacagaaggattgtagcctttgtcattggggacgctaacgactgcgcattggtgtatgatacttttgaccaggcaattgcgaagaacccaggggcgtatccgctctttcacagcgacaggggaatccaatacacaacgcaggtgttccacaataagctggcggaggcaggcatggttcagagcatgtcgcgtattggcaagtgcattgataatggccccatggaaggcttttggggaatccttaagcgtgagcgttattacggcaggcgttttaccagccgggaagagctgacccggatgattgaggagtacatggcctattataatttcaggcgtccccagcgcggcctgggcgttctcacgccgctggaaaagcacgaactgtatagagcggcataattggacctgcacgaaccgtcttgggttacctccggagagcggatggcttttgcatggcaacatgaataaaccgtaaattatttcagtgtctacttgacggggagcagttcaacttggcccgaagcgtatattctcttttttaaaaattactcgtttatactaatttccgtatatccatgattgctgatttttactgttggttctccactacccaaactatatgttttagtccatccagcaggtaacacaatttcaccacggcaggcagatacatccaattcaagattttgtggcatttgattgaatatcagttcacattctccgtcactcgttattgaaatgtcactggaaatggcagttgatatgatagatacacttccagaaagattgtttatattatatatcccgttggatatttccatatcggaaagtgaaattgagctatcatcagcttctatatttatcgcagcattgaaatctggtagagacacgggggctccatcaagtatcatggtaatgttttcatactctttatctggtataccaatttgaactacattggaatagtccgggccgctttcatcaatataatattgcccagcggtggcccgggccgctgttccgtcaacagctatttgtaaaacattatcagtctccattgtataattgactttgaactttgttgtgtcagtaatacccaaatagtcaaacgtaaactttccactgtctgatttaaccagttcaatcccgcaactatctactgttagcgtgatagcctttacgttatttgcttctaaatcctctaatgcagaaactggcgttgtcgtaattgttggggcttctatattgctcggtgtattgggcttttcggtattgccaataggttctggcggcatttgcgtctttgcataggcacctatggccgttgcacctgtcaccattaggagcgtaatagcgagcgtgacagttagcattatttttgatgttctcttatatttcataattgcgtctaacctctctttcagcagttccttactttcattgagtgttacagaggcaaggaaatctttgtagccccctccggctccaatcgcgttcagcagagtatcgccataggcacgccgtccttgtgggtcaagcgccttgataactgcttcatcacaggcaagctcacacgcccggcccacttcccgccccatcgcatagacaatcgggttaaaccagtgcaggcagataacaagctgaaccagccacttataaaacatatcccgccgcttgtaatgcgttagctcatgcagagtggtatgttcaaaatcggcgggcgctagattggtggaggggagcacgatacagggccggaaaaagccaagcaacagcggcgaggaaatgaggctgtttgtgtatatttctactggccttttaactcctgcttgctctccaatcagcgccaatcggtctaaaatcgccgtgtcggaaacctccgcgcgtccagccctgatatattttataaaaccttgatagattgtaattttccgtataatcagaatgagcgccactaccagccaaacaagccaaagattttgtataagaactgtaaaaaaactttgtagtgtcggtgtggcttccgtttccccatttttcggagcagtatcattcttaaccgccgtatcatctcccgattgcggggcgggcgctatattttgtccgggagtggtgtccgtctgcacaatcacacggtctacttgctgaaacagagtgccgacgggacttgcctccggcgtaaacggcaaaagcagacgggcgattaccaccagccagatataatactgccaacgcttgctaatcctgttcctgattaggggcttgcagagaagaagaacaagaattaacagcgacccagaaagggagagcgacaagacaattttcagtatctcgttcatctatcctcacctccaccttcccaaaactttttcaagtcctcgtagtccgtggcggtgagcatttccctttgtatcagcgtagatacaagcccctttgcgttgccctcatagagcttatcaagtaaggtttttgtttgtgccgcttgatagtccgcttcggttacgatagccgtatattcgttgcgtcgtcctatcttgttggttttcagcagccctttttctaccagacgggaaagcaaagtaatcaccgtgtttttctgccagtggttgcccgtttccgccagtgcgtccattatccgggcatacagggccttgccgccctcggcccagataattttcatcaattccaattcggaatccgatacctgtccaatcattttctctttcgccctcctttaacaacaacttgtagtccatacttataataacattttgtagtccacatgtcaacagccttgtgattgacgctgattttcggggtttcacaaagtggcaagcgatgcaagtgtctatacacttgcgaattttccatgttccggcctccgccgaaacctgaaaaatcccgcttgttggggccaaccccaaaccctgcaaaacctcgggccaacttggcccgaggtcttatgggcagatggcaaagggcagcgcgtgagaatgggccgccttttgtcatttcctcataggacaatcagggaatgacatacacatggaagaaagggggcgaatatccatgcaaaaacaaattcatttagcggagctcgcgggggttgatataaccacagtcaacaaagaggacttagttgacgtgtccgggctggccttcgataacacggttccgagagaacagcgggcggcgcaggtgctccgaaaagtaaaaaatccgtactgcttccgggtgggcgatatgggcgttaaactggaatttctggatagcgccccgccccttgaggattgcttcactgacttccttcaacgtaaaaagagcggcctgtaatcagtgtgcaggccgtttttgtcggcctcgggacaagatttgcaagggccgggcaacattgtccacaccacctataaatggtataatataggtgtaaagtgataaaggaaggaggttcacatggcgcgaaagagccgtgttatcactgaaactcaaaagcaggaaagcgtaaaatcatttgaatggaaaatcggtatttatatcagactttccaaagaggatttaaggaataatgatgaatccgaaagtgtaaccaaccagagaaaaatcaatctggaatttgtggaagaaaaattctgcaacgaaacgtatatcatttatgatatttatgtagatgatggacgttctggaacaacagaggacacacgacctgattttcaacggttatcaaaagacattcgtgagggtaatgtgaattgcgttgtttgcaaaactcttgcccgggcctttcgtaactatgccgaccaggggaagtttctggaacagtatctccctacatacggttgccgctttatcgcatttggcaatccctacgttgacacattcgcaaaccctgactgtacgcaaaacatggaaatcccaataaatggccttatgaatgaccgttacgcggccagaacgtcggaagatgtacgaaagacatttcggacaaaacgcaacaatggtgagtttatcggtgcatttgccccatacggttatttgaaaaatccagaaaataaaaatgcctttattattgatgaagaagccgctgaaattgtaaaggagatattcgagaaatatctggctggtatgagtaaactctctattgtacggtacttaaacgaccatagtattctctgcccaacggtatataaacaaaagcgattaggcttgaagtaccaaaatccgcacagtgacccaacaaaaaaccctctttggagtgaaaagacagtgggggacatacttaaaaatcaaatgtattgcggtgatatggtacaagggcgttatcgtataaaaagttacaaggtccatattcaagagaaagtcccggaggacgaatggtttattaaagaaaaaactcacgagccaattatcgaccgggaaatctttgataaagtccagcggttattacaaaaggacactcgcacatctcctaaaaatgatacgctatatttgttcagtggtttcctgcgttgtgctgactgcgaaaaagctatgataagaagtgaagttaaaaaacatgtatattactactgttcgacttataagagacggtcaaaaaaagcctgtacgaaacattccatacagcataatcgcttagaagcggctgtcctgtttgcaattcagcagtatgtataccttgcaatcgactatacaaaaatcattgaacagattaacagggctccaatcatcaagagccaggataagaaattgttggaggctatctccaaaaaggaacgggagcttgccaaggtaattcgatataaacaggctgtttatcaagattggaaagacaacgagattagccagaccgattaccgccgtatgcgggaggactatgaagcacaggaaaaagagataactacaacgattaaaaaactacaaaacgagagagccgaacaagaaaacggtgtagacactgaaaatccttttctggttgcctttcgcaaatatgaaaatgtcaccacactatcaagggacattctgattgattttgttgacagtatcacagtttatgaaggcggcaatatcagcattgttcttcgctttgctgatgaactccgccgggtgcaggatttcattgaaatcaacacccattccgaagcggtttaatatgaccgcattttaattaataattggttttcttattatccatggccccaccggacccactggacccactggcgctgacggtgttaccgggcctaccgggtccactggcaccaaaggcgttaccgggcctaccggacctactggcgctgacggtgttaccggaccgaccggacccactggcgtcactggtgccaatggcgttaccggaccgaccggacctactggcgtcactggtgccaatggcgttaccggaccgaccggaccgactggacctactggcgctgacggtgttaccggaccgaccggacccactggcgctactggtaccaatggcgttaccgggcctaccggagccactggaacagcaggtgctgccggagctaccggaccgaccggagctactggtgctgccggagctactggcccaaccggagctactggcccaactggtgctgccggagccactggtgccgccggagctactggccctaccggagccactggcccagccggagccaccggccctaccggtgccactggtgccgtcggagctactggcccaaccggagccaccggcccaactggtgccactggccctaccggaacttctgttactgccaccagaatgaatgcacttaacacatcaggaaccacccttgcggtaattcttgggggtacagcagttccacttcctgatgaccatgtattaaacaattttacagtcaatgctgccaatacaatctttaccgtttcagcaacaggctcttatcttataacctatacggtccgaaccacggccgctttgctgttatcctcacgtatattgaggaacggcactgcattacctggctccgttatatctcctgctgtatcagccagcgctttctcgacaacccttattgccgacctgactgccggtgatacactggaagtacagctgttcggacttgtgggaaccgccgtacttcagggaggtaccggcgcaagcctggcagtggtacgtctcgcgtgacaatgataaaaggggccggatatccggccccagactcatagaagcataatcgccctattcttaacacaccctaatgtcctggactgtacttaaaatccctgtcacagggatacgatgtcaacgcagagggttccaatgttgaccgcagcggatcagctgccagtccataccaagtccatcccgccctccgtatcctctaacggaccgtaaaataattgtggtacatctggaaaaagttatccgtggtacatccttcccctttggagaaatccacgatttcatccagactatccttaagttttacggtgtgttcctttacaaacggttcatagatggccaggaatgccctggtctttttctcctgggccagcatgctctttctcgccgcggtggcttcctcatcataggcattggtacatttaaggatgtaatatttcccatccagttccaggatatcgctgatttcattctgctccagggaaaatgcaacctcctccctggtatccatttggctgctccattccagggtatggttaatctgcacatccctggaactcctggatgcaatattggcaaagtcggcattggcctgctgtacctgggacagtatatcttcagcccgttccctggagtccagcacaatctgctgtacctggattacttttgcctctgcatcgctcacctccagattctcatcctttgtaagttctgccaccagcttatccgccctgtaatattcacagtacaggtcatagacctcatgctcagtcacatccatataatcccggtcctgctccgacagcccacggtaatattcttttgccagtgacttcagactgtccttttcctgcccggtcagttctatctcctgttcatccgccataaggttggtggtccccagttcaatgaggaactgctcaatctggcccagcagcttttcctcaaatgtggcgccgctgtcatccgcctttacagaccacagctggctggtatatatgttctgataccggttgcgttccgtggctgcgaccaccatgatctgtccctttgtgtaatccttttcaactgtcctcacaccttcagatgataccgtctttttggaacagccggtaaccgacagcccaaataccaggcacatggccagccccatataaacagcccgctttttcatcccccgtactcttattattttacttatgtccaatacggaactcctttcaaagcaggtgtttcaggattttaagcacaccgtcattctcattactgtctgcctggaacctggctgccttcctcacctcatcccttgcattggccaccgcgaaactatagtaagcctgttccagcatttccaggtcatttaactggtccccgaatgccatggtctcttcaggctttatgtccaggctttcctgaatcgtgcggattgccctgcctttattcacacctttggccatacagtccatccacatatcacctgcacaggacatcttcagttcgtccttaaactcctcataaatgtccctgctggcagcctcaatgccttccggcttataaatcgataccttcacacacggctcatccaattcaaggaggtcatttacccgtgtcagattgaacttataactctctatgagccagttcatcagttcctcattggaggattccagataatccccattggctcctgcataaacaatctccaggtccggatattggcggacctttcttatcatgcggtggaccagttccttctctatcgaatacacataaaggctcctgccgcagcagcccacatacgccccattgttggcgacatagaatatcttcctcttaaccggttcaaatgcatgttccacgctggcccagggccttccgctggcaatggcaaactgaatccctttttcgcgcagctttaaaatggtctcaaatacttccggattaatctttgacgaaccgtccggcacaagggtcccatccacatccgatacaatcagcttaatcatcttccctgtcctccaaaagtacttttatctcctggttcagccgcccaagaggcaggcccaccacattggcataatccccgtcaatcccctttatataggctgcaaaccggccctgtatcccgtatgcgccggccttatcaagaggttcgccgcatcctgcgtagtcactcatttcctcaggcgtcatgggatatacatgtacatcggtcttctcagcaaaggtaactccatgggtccttccctctcccaggcagagaagcacggtcaccccggtatatacctgatgggttctgccctgaattttcccaatcatctcatatgccctcataggtgttcccggctttccaagaatctcacttcccacagccaccaccgtatctgccccgattaccatggtacctgccccgcatccggctgctatgtcctccgccttctgcctggacagttccatgaccacctgctccggccttctttcgccggtctcttcctccaactgactgggcctgatttccggttcaatgccaatctggcccagaagttcctttctcctgggagaggcggacgccagcacaacatggtatccgccccattgttcacctctattcatgtcttactcctatcataatcttcagcctcgcacagcctgtaggatgtgcggccagcatacctgccataccacagcggtacgccatgtcaataaaccttcagccgtcctataaccggctcctcttcctccataccgcccatgcgcagcctcaggcagtgtatgaaatccaccaggtagaataccgtcagccccactgccagcatattgccaacattgccggggatgcggattaccagggtgcggaccctgctgtccagcacgtagaagaaaaacaggcccaaaagcccccaggccaggctgctctccaggcataccattcctctataattaaatgccttgtggctgtaatcccaccaaaatgcgccaaacaggcgcaccatgatattggcagtcaccagctccagggtggtggccattgccatggatgcagtataaagttcaatcggccttcctgaaaccgggcttaaaagcatacatgcccccaatgccccaaatccatatatgatgcaaaaggggccatggccaaagccacggtccaccaccggccgcttatattcaacactgagaacgacacattccagtaaatatccaaggaaactatacataaaaaaccagttgatgaagctataaatatccattctatcttctgtccttcctgtctaatgtgacgctatcccccaacacactaaaagtaaggattcattcccagggccagcaggattccaagaatcgcaccagccatgacctgaagcggcgtatgtcccacatattccttaagcttctcctgaagcacctccgcgttcagcttcagtttcagcggattctcactaaggatggaattgagaagcttggcctgcttgccggtctcgcgtctcaccccgatggcgtcatacataacaaccatggacaccacgaatgacaccgcaaattcaaaggagccaaccccgtatttaagcatggcggccgtggtcatgccgcaaacagtggctgagtgggaactgggcatgccgcctgaacccaccaaacgctccgcattaaagcttttattgagagcaaagtcaatcagtgtcttaaggaactgggcaaccacccatcccatgaccgcactgacaagaacctgattgccaagcatttctgtccaaacattcatattgtttttctctttcccctttcgctaacgtctggccggctgtgcaaaaaagcacatcatcagccagcgcttaaaccgggccgttgtttccaatgtactgcatagcttatccgcacaggtcacggcatatccagccttggtcacaggcggtatgggcgtcaggggccacatatggcggaggatgataacctcctcttcccctgtcagttcaaaatacttccctgcgttgcggagcgcttccttgggatgggtaaacccatgaaaatgcttccctgtttccctggcatgtgtatgccagtcgtataaaaacaaatcatggagaagccctgctctcgcagcgcttctccaatttcctccaaaccttttacataacttatatcctaaatatgaaacctgtatgcagtgggctttacatgtggtagtcccatgctgtatatactgatccatagactggaatacaggatgctctaaaatgtccctgacacaatccatatattcctgattccccgtgtagtcatataatccggacggctccatgggcatcacacctttcttcttttatcagattcattatctgacatttcaggtccgctgtcaatatccaatcagccaatcataaagttcctgatacttggcggcagaggttgaccaggaataatcctttgccatggccctgtctatgatcttgttccattcacggcgcttattgtagtaaatatacattgcataccgcacgctgcccaacatctcatgggcattgtagttggcaaatgaaaatccggtaccggcgccctcatattcattatatggttcaaccgtatcctttaatccgcctgtctcccttacaatgggaaccgttccataacggagggacatgagctggctcaaaccgcacggctcaaacagggacggcataaggaatgcatcacacgccgcgtaaatcttatgtgacattggctcagaatagtaaatctgagcggacaccttatcatggtacttccagtcataatgacggaacatgttctcatatctctcgtcgccggttcccaggactaccagctgcatgttatcattacacagctcatccatgacgccctgaatcagatccaggcccttctggtccgtgagacgtgagacaattcccaccatgaacttcttctcatccacaggcagtcccagttcctcctggagcgccttcttattctttgctttttccttgcggaaattcctggcattgtacttctggacaatatatgggtctgtctcaggattgaattcatcgtaatcaataccattgacaatacctctcaggctgtttgcccgggatcgcataagtccatccaggccttcgccatagaacggcatcttaatctcttccgcataggtatcgcttaccgtggtaatggcatctgcaaatacaattccgccctttaacagattaccgtccttataagcttccagcttatccggagtaaagtaatagctgggcagttccgtaaagcgctggattgtcttaacgtcccatacgccctggaacttaaggttatggatagtgatgacagacttcatatcacggaagaaatcaccctcatggaacttatccttaagaagcacgggtatcagtcctgtctgccagtcatggcagtgtaccacatcaggctggaatccgataacaggcagtgcggacaaagccgccctgcagaagaaacagaacttctccagatcccagtaccagtctccatatggcttgggaccgttaaaatagctttcattatcaatgaaataaaaagtaatgccttcatgtacatacttgaggatgcctacgtagcggctctgtcccaggaagtccatataaaaatggtccacatattccatcttggaacgccactgttccttgatgcacaggtacttcggtatcatgacccttacatcgaaatactctttgtcaaagcatttgggcagagagccaaccacgtctgccagtcctcctgttttgataaacggcactgcttctgaagctgcaaataatattttcttcatccaaacctccctctcctgacgaacaggttccttatgcctttccatatagtataccgtattttaccgaaattaggaagttttttctgacgaaattgttttaaatttttttgtattctaacaatattttatctgaaatcagcgcaataaactcggagttggtaggtttacctttgcctgtgctgattgtatacccgaacacctcgtcaatggtctccattttccctcttccccatgcaacctcaatcgcatgacggatggctctttccacacggcttgcagttgtctggttccgtttggcgatggcgggatagaggatttttgtgacggaactcatcatctcctggtcctccacggacattgcgattgcatcccttaagtactggtaacccttgatatgggctggtatcccaagttcatgaagcattttcgtaatatccgtctccagatgttccttcatgtactcttccctggtgatgtgcgactcctctccaggttcaaatggagcagataccacctttccagtcatctgtttctcaggcagttttccaatatgacgaattttattcaccaggatttctttgtcaaaaggcttcatcaaatagtagttggcgcctgctttaaacgcatcttctgtcatctgttccccgcctactgcacttaaaatgataaacgcagggtttttcataaatgtatgttcgctcttgaccttttccacaacagatataccgtcaattttcggcataactaaatccaacagcacaatatccggcgttgtatctacaatcatatcaatggcatctgcgccattgtcagcctttccaatcacggataatccatcttcagcgttaatcagctcatccagagtattcagaatcagcggattgtcatcaacaatcgcaacattcagcttttccacttccttttacctcctaaaattgtttgcctatgctaaactgcctgctaaaatatgtgttagttgattttcgaccttatggtttacaaaaatccatatcattcgtcctgagctcctggcgaatcttattatatatgctccccatagcatatatcaacgattcgtggtcgcaattttagacacgtgtcgaattatcattgtatcattgagggtgacattttgcaatatattgttttatctattaacaaatttgtaattaatatccagtacatttttggaaatattacacaattcgacaccttttttatcatttccctcttttttcgaccattatgtccatatttctacaggcaatatatagaacgcacagtcccttcatttctccctgtcttttgattcagaaaattttaaaatcctgtcggaacaggatacctgtaaaccgcagattctttgtggaatgcgtatagaatagcccccctgccgccgtctatatgagacaccgttccccggcagataccataccgttcctggatgtccttggtatattatcaaaataatcccgggctttgcagcattaaattgttatttaatccactggattgcaggtaaaaagaaggaaaagccatttcatgtgccataaaataaagttatatggccgtgattaaacaagctagttatatgacacagaattatgtctgtctcctgatttggtatctataacaataattcatacaatccagcagctggcgccttttctctttcagaaccatctaattccgttactcaacaggaatacggtttactgtgcattatccgacatcaggcacatccagtcctggttctcataacagataacagatgaaaaagacggcccgctcataagaaccggccgcccattgacatgtctgtatcagacagacattatctcgtcatctgtgttttttcttttcattctcatagatttccagaaactccactggatttttagtaaagattttttccaattcataagacagggaaaatggatcataatcactaaaaacattgggtatgtactgataaagcttatccgctatgccctggacatgctctatatcagtcccggtcaggctgtagattttattttcagtgaaaatgagaagcttcacaataaacgggcctcccttaatcccaacttgggcgcatatccaataaaccttatggcgtgggatagccgttacctttgaagtacctttggggccgccctttaccccgcatagaagcaaataagaaggcatcaaaacaatcttctctccagatgccttcgcaggatctgaaaatttgtctatgtattcctctaccaggattttaccctcaagcgcttccccgtcaataatccttccagccgcttcctgtgtattatccttataagggagaaataaattatcgccgttcctggcggtccgtcctgttgcaatcaatttaatcactgtgcaaaccagcacaagacctattatgatgattaagtaaaaagatatactgccataagaaatatcgttgaaattgatggaatcctttccaagaagataaattactgcgagggcacaggcaaacacaatcaataatttgtaaaacattttcctcgttgccctattaacacgttctgattcctgttccaagtatccatgatccatattggctttctccttataagtttattccgtactgtttacttacgtataactgcatggtttatttttcaattcattatactgttttttctttctgagcacaagtcaattcagatgggaagatgctggattgtaagttaccaggattgaggtaaccaaggccttgaagcagccactcctggggatacaatcctttaacctcctctgaagcagttacctggaatgttattgatattgataggaggttacatttctgccgttatcataaaaaggcccctgcatattcagctatggcggagccgtttaattatgtttaattttttaagctgttagtgtggaattgctgggaacagacttttctttatatttttaaacattaaaggcgaaccccataaatcatattgttgcaatcgccttcaacttattctagaaatatatgatatatctgattaaatttaatatcgcaatgtttttcaagattaaaatattcacttctgaaaaaacttttctctctgttttttcggatgggattttttcttgaatacagattataactatttcataatcaccaggaccatatttttatattacttcctgcaaaacaatttgcatcaaacatttagtccttactgatacacaatatcataattccgtaacacaagatagaataattctttgcttaaattacatagttgaatcatactttttccacaaagggcgactgtttcgatttttcctaatctggtcgtacttttacttctatcctccctttatgaaatgagatacatgcagacatcatatagtaccatgtattatcaatttcaattcactcccttcgcaagaagggagaccttttcgaataccagtcctgtatgccaatagaatctcttcaatccactcccttcgtaagaagggagacgccaatcgtgactgtataagtcttgtcacttatatgcttcaatccactcccttcgcaagaagggagacgcctccggttctctttacagatacctgtccatcgcttcaatccactcccttcgcaagaagggagaccagcgtgtcatagatgtgctttggggcattgtcgcttcaatccactcccttcgcaagaagggagacagggtacgtacccatatcaactgacctgtattatgcttcaatccactcccttcgcaagaagggagacaattttaggagaaaccccaatccaattatcaactgcttcaatccactcccttcgcaagaagggagacaaacttcctgtaatctttattatcgtgagataatgcttcaatccactcccttcgcaagaagggagactgcatggccattgcgttggatgtggcggcttttaagcttcaatccactcccttcgcaagaagggagacgaggggccctgcggcccctcaacctgacaggagggcttcaatccactcccttcgcaagaagggagacgaataggaaagagtacgtttctggcctatctggggcttcaatccactcccttcgcaagaagggagacccggtgagatctgcgctctggagtccggcaatatgcttcaatccactcccttcgcaagaagggagacaggcccctggcagggctgagtgcaagaaagggaatgcttcaatccactcccttcgcaagaagggagacaaggggagtatggaagacttgcggactatttcgtgcttcaatccactcccttcgcaagaagggagacaactaactctaaacccacatacccacaacacacaagcttcaatccactcccttcgcaagaagggagaccatttgagccccccctttgttattatccgtttggcttcaatccactcccttcgcaagaagggagactggcaatggcatcataatctgtatcacgttggtcgcttcaatccactcccttcgcaagaagggagaccgtaaattcagcccctgctactggcatccctcctgcttcaatccactcccttcgcaagaagggagacatcgaatgtggctgcaaactccccaagtgcactgcttcaatccactcccttcgcaagaagggagacagtgaggattgccacaaaatcactaactggcacgcttcaatccactcccttcgcaagaagggagacagcaaatattaccaataaaccactctaaaatttatctataactaacattttttctaccatacacgtcccaaaacttcccccaaaacaatcaaaccgtttatcataatcccatatccatatcataatccagtgcgaatcccccagggttttaatgagagcatcacattcgcactacataatcaaaggttctgttacatcgaatcctggctttgcccccatatgctccaccttatttttatacttgtcacccaaatagtaaaatctcaggctatccacatttttatctataatcttttccaggatagcttttacttccctgcattttgcagcatccatattacattcaaagactgaattctggacccgctggccataattgacacattgcttagccacctgccggagacgtttccttccagccgctgtttctgtattcacatcatatgtgattaacacaagcatcccatcacctacttccaaaagaagggaggatattcatccaagtcaccacggatataccgagccagcaatagggcctgaacgtatggtaccatcccccattctactttttctcctaaaaagggatgacggattatctcctgttttttcatctgccactgagacaggaacagctttctggtgtcatcatccataatcactgctccattttccttttggtcaaatccctccggcttcactatttttttattaattaaggtcaacacaaaacggtccgccagcacacttcttaattcttccaccatatccaaagctaatgatatccttcctggtctgtctgtgtggaaaaaccccgcatatggatccaatcccaccgtctccaacgctcctgcacacatccctgtcaacagtgtatacgcaaacgacagcatggcgtttaccttatctgtgggcggacgctttgatcgtccgcgaaaaaagaaatcctctttttgctgcaatatcaaatcatcaaatacggaaaaataaacagatgccgcttctccctcaagcccccttaacacatccggttccttacacacccttatttttttcagggaatctgataaaaaaccggattttctcttcagcttctctccatctaacctcataggataatccctaactgcgcgctccagtacccatttttcattatatacttttcctgctatgcagttccgggaaatatccatgctcttctctaaatcccaggcaatcctatattgttccctgcgcagtgtgatattcccacgcacctcgccggacaccctggccagaaaccgcccgcttcttgacaggaaggatatgccgatatcccgtttcgcacatgctgccataagcgccggactggctcccgtatagccaaaggtcacgattgcttccagattatgcagaggcacccttcctatttcttcctgtttttcataaaccaccacattttccccgtccagggacagatatcggtccggtgaggtaatataaagtgtgttcagaagtcttttcatgacagctccttatctggtatagtattgtgtaaatccctgtgataatcatgctcatcacgtaattcaatcccatccttcacttttcatccagcatcttatcgatatatgctttcgctgtcttatcctctcccagtactggaaggcagatatcctttaaggaacaggcattacagctttttgtacgttttacccggggagtatgctttttttcaaaatattgatgcatttcacggaacatatcccgggttttctctctcatcctatctgtaatatctatctgcgtcctatgtctggtttccccgtaaaacagatatcccaccggtatttcgcaacacatcatctcttccaggcacatggcctgggccgtcagctgaagtatatctgaatcgttttccttgggttctcctcttttgtactccactggtaccacctgatagagcccatccctgccgataaggggaatcccactctggcttctatggaattctaccacatcgcactccccactgattcccaactccctggaatggaccggcattgccctggaaacaatgatatcgccccgtttctctgcaattgtcctgtcatgggcccgttcgtgaagcagatgcccttctacagtccgtacattttcattccactggagttcaatatatgccaatgcccactgtctcctgcaaaaggaaaagtgttggattcctgataactggaggaattcatcctcttcatacaaaatcgtatacctccggttttacactgtcaacaggttcccattccacctgataatcctcaaatgacttgggacgctctaccttgggcgtaatctttacacttctgtgaatttttgcagatggagtcttgggtgtcttctcatcatgctgccaccaatacaggcggcatacctccatgctgccttccggccgggcagaggaagcatcattttcaaataatgttttaagagcctcttttaagatgtcagcatcttcctgggaaaatccggttttctcagccagctgtacgttgacactgcctttcaccacatacaacccgaacccaatcctgtgctttgtgcccatggtgtccgatgcctttccctcttttccagactcactgttcacgctttttgtaatctgcatactgattatatccacaggagactggcttactgcctgatggattgaaacaggaccgcggattcccagggaaacatccacgcccttaaaagcaaaaacctgtccgaaacttctcacatccatccattcccggcatgcaatctgggcgcacttctccttgttggccttttttccctgtttcatctcagccttcaaggcttcacagccctccgcacgctccctcaggctaccgaagccatcatccgcacggtcatcagattgtacaaaaatcttctgtcccatatcctggaaccggttcctgatttttctcttaatacagacatcggaaatctcaccataaccatcaaaattctccctggggcggttcccgttaagcggatctccatttggattggcattggcagccgaaatcagaagtacaaaatcaatttttccctttaactcactcatttcttttcctcctctgcataatttctaaatgcatatgactgattgtggtatcccaacagataaaggccattcaaggcgtcatttttctcaaattccccttccttgaacttccagctgatgtcctctatcatatgttcataatacaacctctctggcaatggcagcttgacaaagtatggttccagcctttcttctataactttccacgtcctaaaaggctgttgggaaaatgcattcataaaacgctttgcattagtctcccttacctcatctttttcaaatgtccggtactccaccctgtcagctactgccagcagtctcccgtataggtaattcctgtcctggctctctgtattaagtgccactgtccattcctccttcctctgttccatcctctttttcttctcaaaggaacacgccagcgccagcacgcgctcccaattataccggctgtcatatgacactggggatgaagccttccggtaggccaggtgtaccatatcctccggaaccggacgcccggaaataatgcagggcagcaggcgttttaaaacctccgcatacatcttctcattcccgccttttaaggtcagcatcccattctgctccgacccatataaaatatcagctatatccctcaccccggccatcccataatataggaagtactttttatccttaaatttcggatgcagccacccacagccggcatgccattccttcaaccgtttcagataacggctggaatcaaggctctcatattccatcatggcaaggcgcccggtggtagcagcgtcaaaagccatcaggactgtcctggaatccacatccaaccttgccccatatcctgcaatcgcggcctggaatctggcggcgcctctggaatccgtccccatatattcaggcactttcttactttcttcttcatccccccagatatcctctgactcataaatatcacagaccatatccgtatccagacaccagtccggaaggggaatcaagtccgactcccaagtcaccacacagagactgttccagtttctcccctgtctgcggataatccatttcagggcattatgggctttctgggaatcctcatatccgatggcaaatgcctcttccttattggaaaatctgcccctgtatgtgtaatatgtctcatcattggctgaaatcagctttgccccgtccccttcattccttatctttttagggtggagataggaaatctgttcctgattcccggtcaggtaggaaagccctctctgctgccacgaagcgcggcagtaggcaatataagcattttcaagagaaacatccagccagcactcaggccgttccgtcccgtccttttcctccagcaggttttcctcagcatcccagggcttctcaacccggaacctcacaaaagagtctacctgggatacattctgtatttttatcgttttcaagaccttaccctgcccatccgttttcaggcacccataggaaaccaaatcccgcatcagacattcctggttcagataattccagatagcatgtaccttttcatgcgaaaatgcagattcagcccatttcttcagcccatccatatatagcttgtggttttctgtataatcttttcctttatccggcaccacgtaatccatataatcaccagccagatattttaaattatcacagagtggatgggcttctacaccagctgtccggctggccgatttctctgtcaccggtatcacggtcagcttttcctcatcctccacaggaaccgcccgtaaaaattcccctttttcattaatggtcaccgtaatctgagctgcaaccgtagagtggaagactggaagtagaatgagtggttccccaaaacggcccttttcatactgaccggcaagattcgcatttttttcatataaatcacataattcccttacccagtccactcagacacctcctcttcggaaaattcttctaggcctgaaaaattcctgttatcaaacagcttcatctccatgtctttaatatgacgtttatccatacactcttccggtcttgggaaatgaattacgccatttctcatcaccggacgccagaacctgactgtcatcctgcctttatcttcatccaggacagcctcatccgcataagtaataccgtgatacatgaatccgtacgccagttctgcaatgccggaataaaatccctcatcctgccccgtttcaaaatcacatggctccacatatccctggcactctcgtgtcccaaggaaaatgtcacggcgtccgcctctggctatcatccgtttagcaatattatgatgcttgttctcattgcggtccgcggcaagttccggacggttcatattccattcgaaatgtgcccttacctgataccgaacatgtttcagatatgtgtagtaggaaaggtcatttccccctccatatccgatagggcgcacgccctttgtctctgtctggattggattcatgatacgcacagcgtcaataatccaaactattgttggcttccaatatatgctttgcagtatgccttttaatgcctcatacgtaggaatctgataggaaagcttttcccctcccactctggttaccgggtctgcaaacattgcataattaccgctgacctgaaattccaccctgttttcatgcataatccctttcacctccttttctttctctgcctatatcatcaattcggtcatcaagcctggattctgggtaacccccagattctctttgtcataataccgctcgtccaaaaccagcactctcccctcccatacagtatgaatagcgtcccccaatccttttttctctgtcccggatatggcaacggtaaagcgctgcagctttctaagcgcctgcttcttctgctgtaaggaagccgatccgcctgacaacctggacagcaattgtacagcctcttcattgtacggaacgatgaccgtggtctttccattctcttcaattgcctcaaataaatcccccgcggtcttaaatgcctgttttaatatgggcagacctgcacctttacacgctgttgtcccttgctgggatggcaggaaatcatggttccccgacaacagttccaccaagctggtggaaaccccttccacggtttcccggtattccatctccttcagccatttttggaaattacattcatagtacatctttactgccagactgctatccagccgtccacctaatacttcagggttcctgtaaaattgggccagcacctgttccgtggattcctgtgccctccggatataggccagatgggagagattctcagcatctcccgacattttcacaataaaaacctttcccatgtcaacttccttgtggcggttacagcgacccgcagcctggatgatattatccagccctgcaagggaacggattacacatcggaatgaaagatctacccctgcttcaatcaattgggtgctgacgcatataagaggaatcggatcctccccatgggatttcaaacagtccgacaaatccttcaatacatcactgcggtgctctggacacatccctgtactgagatgataaagcttaaatcgatcttcattcagcgactccagcatcccaaataattccctggcgcaccgttttgtgttaaccacgaataatacctgtttcaactcccttgccttttccagcacaaatcccgctgctttccggatatccataccgcccggaaccaaatccgtacaatctattatctccgtcctgcgaaatgcttcctgatagaaatccacatatcccgtcatatctttcggtggacggagtcggtttacaggtatcctgtccaaaaggggctgggttgccgtgcacagtaccatggtggtatccgcaaactctgtcaggaaatttacagccatgttgaataactggatggtcctgaccggcagggactgcacctcgtccatgatgatgacactattacatagactgtgcatccttcgtatgttaccagtcttaccggcaaaaagggtattcaggaattgcacggccgtagtgacgataacaggaagcgaccaatcttctgtaacacggtcatagtatgcctgttcttcctctgtttccagaataatattgcaatgatgctccagcacgatgccaggataatccaatgcattcctaatctcctctgcattctggtccaggattgattgatatggagctacatagataatccgccttttatgatactcaagggcgtggcggaccgcaaaacggaggctgcttaacgttttcccggaaccggtaggcactgtcaggtgatagagccttatattctgcagcgcctgtttcatgcatctgtctgatatctcactccggtagcggtttataccgctcttgtccatgaaatcagcatactttctttccacatgttccacgcatatcctccagacatcctgaagcttttcggaagaatactcttccggctgacggaccgcttcaccatcctcggtcatgaaatcttccgtatccctgcggtcggcgtcaataagcagggataataaaatgcgctcatacattccaaggaaaaaatccctgttgccataaagttgcggattatcccagctcttcatgatatccttgattcttttaggaatcagctttgattcttccctggctccggcacatcttttttcaaattccgatggttctaccgcctgatagaaatattcctttgcctcttctataggcagcttcttcgccttttccatccgctggcgcaacaggatggaactgtcaattatggaaatacagtccctcaggccatggtgggagtagatggctatctgtatcatctcagatagcagcgtacctggaaagatttcctgaatcaactgaccgcccgccgtagtatggtcttccttagggccggatggaatgccatcattacaaatggctttcatgaaatacttctgccagcgttctggatactttccggaatcgtgaaggtgacaggtcagccatagaatgtcttttaaaatagggatgggatttttcttttctgcgattacagcggtgtcggaattgtgtgtggaatttagttgatatgtatcagagtgggggttataatgagcataaggttggttcattattcatatccctcctttgtaaagtagttagaattgtacaatgtgaccagtgactgggtagggggttaattctaaatatagattactacttgcaggattgattgtcaatgatatttttattatattttatatttcatataatttaaatctcataaaacttaaatgtattcttctattttattttataggaaattatagttttgacaaaacgttcttatttcattataatacaaatgtcgaatgattcatatttcgtggattgaaagaaattttatgaaatttacagcagctttaaagaatagggtccatcacactgaataaaccaacctgtgtgatggtcccatcttctccccaataccttattctctattaccgtactcaacgctccaacatattctcaatcaaaatcccataccccctgctcgcatcctgcacaaacacatgggtcaccgcccccgccagtttcccatcctgtataatcggcgacccgctcatgccctgcacaatcccgcctgtcaattccaaaagtctcgggtccgtcaccttgattaccatgctcttattcttgtggctggcattataatccaccttctgtatgtctatctcataatcctccagttccccgctgatattgcttctgatataggcaactcccggtttcacgtcctggcggcaggcaatctccaccggctccccggtcagttgcttcttgaactgctggttcacggttccgaatatcccctcgttggtattttcagctatatcccccatatgggactgcgggccataatagatgacgcctgaaagcaggcccggtttgccgatggttcccttttcaatccccatgatttccgtggaatacaaggcgccctgggacgtctccaccaggtccccggtgtcactgtcgctgattccatggcccagtgcaccgaaattaccattcatatccacataagtaatggttccgattccctgggtatcgtccctgacccaggccccaagcttatatttcccgtctgaacctgcaatcggttttacgctgacatccactggttccccgtccctgcgcacggtcacaactgaatcctggccgcctgattcatttaccgcgcttataaggtcttcctttgtcttcatgggcttaccgttaaatgcttctatatagtcccctgtttttaaaatgccgtaggcaggctccacttccatcccgtccggccctgtaatccggccggtgccgattaccatgactccgtctgatttcaggtaaatgccgattgggcttccgcatgggattgcataccgcgtatccaccacatccacctggatgtcctttaattttataatgccaaacagcttaagccccacctggtagcttccctgttctcctgcaatcatggaaaaatgctgcctgccgctgatggtaatctggtcggccggtatattgctttcatttccaagggacacttcctcactgtcactggaaatggttgcttttaaaggcagtccaaaggaaaaatcctcctcctggttttgtatgatgcttacccggtccggcaccgcctgatccatataataccacgtgtatcctgttacagccacaatggaaagccagaaaatacgtcccagccaccggtaaaatttagattttcctgtcatcgccctgcctccttatatagtcttcatgttatttcggcaagagcgtgtttttaaatgcttccgggcgcttttttacccgccggattcattttaaagtcaaaaaaagaaagacgcatgctcactgcctctttcttagtattatccgtcctgcggatttcaatctgttttattttgtcctgtctgccaaatccttcatttcggctgcatttttacgcactgtatccgtaatctccgcgccgcccaaaagcctggccagctcctctacggatgcctggcggtccagaaggcggatggttgtgagggtgctgccatttatggcagattttgaaatctcaaagtgggcgtccgccatggctgctatctgtggaaggtgggtaatgcagatgacctgatggctgcctgctatataggatagcttttccgataccttctgggcagtcctgccgctgattccggtatcaatctcatcaaaaatcaatgtggggatatcatcggaatccgccagcacggtcttgatggccagcatgatcctcgacagttcaccgcccgaggccacgtcctttaagggccgcatgggctgtcctggattggtggaaatgatgaactgcacctcatcccatcctgatgcgccaaaatgctccaggcgcttgaattccatgtcaaattccacatccaggaagttcaggtcgacgagtccgtccctgatttttttaataaggtccctggacgcttttttacgtatccctgataattgtgcgcagaatccttctaaatgattcctgcattgttccagttccttcttggtctgttccctgtgataatcataatcctccagttcgtccagccgtttccttttttcttccagtttctggttgattttagaaatggttgcgccgtacttggcctgcaggttatggattaaatccagccgttcctcggtctggcggaatgtctcctcatcaaattccatggaacccatgtaggaggatatttcccgctttgcatcttccagtatggaatccgcatcataaagctggtcccggataccgtccagggcatggtcaaattccaccacctgctccacttccctgagggcccgcgacagccactccccctccaccgcattataggcatccccaaggctggccgctatcttctgggaatgggaaaaccttctgtaaacagaagtcagttcctcttcctcgccttccttcagcccggcctcctcaatctcctgtatctcaaagcgcaggaaatcagcttcacggatacggctttcgctgtccatgtcaaactcctccagacgcttgataagggcgcggtaggactggtattcctttgcaatcttctgtttgacaggctgggtgctggccttaacataggcgtcaagaatttcaagatgttttgatttatatagcagggactggtgttcatgctgcccatggatatccaggagaaggcctgtgatctggcggagcctggccgtggtgaccgtctcatcattgatacggcttacgcttctggatggcatgatcttgcgcgagacaatcacggttccatcctcagcaggctccacctccagctcctttaaggccttagccttatcctccccggacacagagaatacaagttcaacataggcgtaatccgccccatggcggatgctctccctggaggcctttcctcccagggccatggtcacggaaccgattatgatggacttaccggcgccggtctcacccgtgagtatgttcagcccttcgccgaattccacatctgctttctcaatcagggccagattctttacatgcagttccagcagcatcttgcacctcccattcctatatattaatcctgtaccatcttcttaatcttctccatcacaataatcgtatcatccacgcttcggattgcgcacatgatggtgtcatctcccgcaatacagcccacaatctcagtgaagtggatggcatccaaagcagctgccacagccatggccatgccggatacggttttaatcaccaggatgttctgcgccatgtccatggacatgaaaccatccttcaggatacggatatatttgatggctgacgtgccggccgggctttcaaggaccatgtaacgctgccttccgctctccgactgcatcttggtcagcttcagctcccggatatccctggacacggttgcctgggtcacgttgaaccctgcctggttcagcttttcagccagctcctcctgggtctctatctcatactttccgattagttctacaattttactgtgcctctctactttcatgtcatattctccccaaatgattgctgagattctgcataaatgaaacctgttttaatttaaccatgaccgtctccagcctggaacattcaatgctgatgctgtcccccgctgtcagctccacaaaactgtccccgtcaaaggaaaccacctgtccgctgttaagaagccggatttctatcttgtcctccggcgccagcacgatgctcctggcattcaatgagtgggaacagatgggcgtaagcaccatcatcctggccgatggcgctatgaccgggcctccggccgacagattataggccgtggaaccggtgggcgttgcgaccagcacgccgtccgccgcatattcgttgagatattcatcatttacatagactgagtaccgcaggacttttaaggggtcctgccttgtcactgctatttcattgagcgcgatgtcctcaaggaccggcttgccgtcatggtacgcaattcccttgagcatcatccgcttctccaactggaagcggtcctccaatagcgcgtccattacaggggcaatgtcctcctggcggctgatctggttcagataacccaggtgtccccggtttacccccaccatggggatacatcttccggccagatccctggccgcctgtatcagtgtcccatcccctccgatggtgatgatgcactccgtgtcccccggcacctggccggaatccgtgtgggtgctctcccgccccttctggtatggattattcagcctgcacgcggctcccttggcctccagatacgtcttgatgaatgcctgggcctcttttacatattctttatccagattggcaataatataaaaatgtctcatggttaggctcctgccgttttatgtgtatgctctgtcatatcattgatgcattgatgcggatatgtcatttatccagggatccatgggcctgctccacaatctccctggcattcacaggcacctggctgtacaggaccatttccccgtcctgcccctcagggtggttctgaaggtaaagcagatactcgatattgccctcaggccccttaatcggtgagaattccaggttcagcacctcaaaaccaatgcccaccgcatactggatcaccatgtcaatgacctccagatgcacgctcttttccctgacaacccccttcttgcccaccttctcacggccggcctcaaactgcggcttaatcaggcacacaatctgcccttcctccgtaagcaggttcttcaccggccccagcaccttggtcagggagatgaaggatacgtcaatacttgcaaacatgatcctgtccccgatatcgccgggcagtacatagcggatattcgtcttttccatacagacaacccgctcgtcattcctgagtttccatgccagctgtccgtgtcccacgtccacgctgtacaccttaaccgccccgttctggagcatgcagtccgtaaatcccccggtggaggctcccacgtccatacacaccttgccctcaagctccacgccaaaatggctcatggccttttctaacttcaggccgccccggcttacatacctgagcgtgcttcccctgacctcaatctgggccgcggtatcaaaggaggtaccggctttatcttccttttgtccgtttacatagacgattcccgacatgatcagcgccttggccttttccctggactccgccaggttcttctgtaccataagcacatccaaccgttctttcattatcccagccatcctcctgccttcatgctcctaatgatggaatcgctgtcgattcccagcccttcccttaatatggacacattaccgtgctccacataggcgtcaggcagcgctacattcaatacttttatatgagggaaatgctcatggatataagccgtcaccgccagcccatatccgccctggagcacattttcctccaatgtcacaataaggctgtggttcccagccagatgtgctatcagttccgtgtcaacaggcttcacaaacctgccattggcaagggaacaggaatatccttcctttttcagcttttcccttacgtgttcgcctgtgctgaccatgcttcccactgccagaagggcgatgtccttttcctcgtaaagcatctcgcctttgccgtaggcgatgggctggcggaattccttcagcccccggtatgcctcccccctggggtatcggatggccagagggccgttatattccatggcaaattccagcatggcccgaagctcccacaggttcttgggggccatgacgctcatgttggggatgcaggtaaggtaggagtaatcaaaaatcccctggtgggtctccccgtcgctgcccacaagcccggcccggtccactgcaaagagcacgggcaggttctggatgcagacatcatgcaggatctggtcaaatcccctctgtaaaaaggaggaatagaccgccaccaccggccttaaccctgccgccgccattccagccgcagaggtcactgcgtgggcttccgctatgcctacatcaaagaaacgataggggaatttcttaccaaacgcagtaagccccgtgccgtccggcatggctgccgtcaccgccaccagattgggatactgttcacccagatggcagattttccttgaaaatacatccgtataggacggatactgctgctttgacaaaggcttcccggtctccacgtcaaagggtcccaccccatggaactgggaaggattcttttctgccggacggtagccttttccttttttcgtgattacatggaccagcactgagtggtccagcttctgcgcctccctaaataccttgcacatggccgggatattgtggccgtccacgggaccaagataggtaatgcccatgttctcaaaaagcattcccggtatgaacagctgcttgatgctgttcttggtgcgcttaatcttgtctatcatcacagaacccacaaccggtatccggtcaagggcatctgccacattcttctttaagtcattatatccgctgcctgtacgcagaccatttaagtagcgggacatgccccctacattctccgatatggacattttgttgtcattgaggacaatgatgaaattcctcttcatccttgcggcattattaagcgcctcataggccatgccgcccgtaagcgccccgtcaccgatgacggacaccaccttataatcaagtccttttaaatccctgccaagggcaatccccagtcccgcggatatggacgtggagctgtgtcctgtgtcaaatgaatcatatgggctttccttgcgtttgggaaaaccgcttaagcccccatactgcctgagttcatcaaaatcagccatccgcccggtcaatatcttatgggtataggactggtggcccacatcccagattaccttgtcctgcggcaggttgaaggtagtatggagggcaatggtcagttccaccacgcccaggtttgaggccaggtggcctcccgtatggctgattttctctatcaggaaatcacgtatctcctgagccagggtttttaaatcctcgggcggaagagctttcagctcctccggccccttaatctgttccaatatcatattgatggttctccaaatagttacaccggcttacttctgcctgttaatcagcacatggatcagctgctccaggaactcattgttgcccggaagtttattcagttcctcaatggcttctgcggatatcagctccacatccttctttgccttgtccaggccctccagcgtcacataggttgtcttcttattcttctcatcgctgttcaccggcttgccgattacttcctcgctgccggtcacatccaggatatcatcctggatctggaacgccatgccgatcttccttgcaagggattccacaatcttacagtcctcatccgctgccccgcccagtacggctccgatcagcatggaggcttcaatcaaggcgcctgtcttcaggcggtagatgaaatccagcttatcctttggaatcgggcctcctgccagctccacatccacggtctgtccgccgatcatgccgtacacgccggtcttgcgggcaaggattcccacggcttttccaatccttgacagctcatccgggtcaatgcttgtctcaaatgcagacgccgctgtctcaaatgcatacatcataagcgcgtcacctgtgagcacgccgatatcctctccgaactcagcccatgtacttggcttgcccctgcgcatcatgtcgtcgtccatgcagggaaggtcatcgtggaccagggaagaggtgtggatcatctccactgccgccataaacggaatcacggactccaggaggcagcctgtgaacagacggcacatctcctgcatcagcatggggcgcagacgcttcccgccggccatcatgctgtagttcatggcttccagaatggttttctggtgtccggactcctccggcagatacgttttgattaactgttcaatctccgctgtgcgtgttttcaattcctgcttaaatgtttccttgtcattcatcttcatcaccctcgctcaatatctgaattttcttttccactttatcaatctggctgcccagggactttaccagcttcattcccgcctcatagcacgtaaacgattcttccagcgtgatgtcccctgcttccagttttcttatgatttcttccagccgcacaaaattttcctctatgcccggctgtttttcttcctttggctgcatttttgcatcctgcatctttgtgtcctgtatctttgcatcctgtatcttcgtgtcctgtttcttttctacgttctcctgcgcgtctgctttcctgcgtggcattccttactcctcactttccggcagcctgacggctacggtctttgttacctgtgcctctatccggccgtcccttacacttatcccaatcctgtcccctatgcctgtctgctcaatgcttctgacagcctttccccgcggatccgttacgaatccgtagccgccgctgagcttttttaacggggacaatgcgtccaggcggccagcggccagcgccagacggtgctgtccggctttcaggctgtccgacatatacatgtccaggcgctgacgccggtcctccagactgcgcctgtcctgctccagcttatcctttaacctgcgttccaggaaactctcgatatcagccagacgttggcgccggtccaccagcagccgctccgggctgcgcagcttcaggcgcatctttccctgctccagacggaagtggagccgttccagcttcctctccatggaacggtttaaaacctggctgtacagtctgacctgctcctcaaactggctgtaatcaaacacagccaattcagccgcagcggacggcgtgggcgccctaaggtccgccacatagtccgcaatggtcacatccgtctcatgtccgaccgctgatatcacaggggtggagcagttaaatatggccctggccaccatttcctcattaaaagcccacagatcctcaatggaacctccgcccctgcccacgatgattacatcaagtcccatggcatccagggtttcgattccttttacaatgctgtactttgccttctcaccctgaaccagggccggatataacaccagctgcacatagggattccttcttgcggaaatgttcatgatatcgcggatggcagcgcctgtgctggcagttacgatgccaaccttcctggcgtatttgggaatgggctgcttgtaacagccgtcaaacatccccatctcctccagttccccgcgcagcttctcaaagcgggcaaagaggtcgcctcttccttccctggtaatctcctttgcataaagctggtatcttccgtcgcgctcatacacatccacattgccggttaccgtgacttcctggccttcctccagttcaaaggccagtcccttcctctgccctgcaaacatgacggcggcaatctgtgagccgccgtccttcagggtaaaataaatatgtccggatgtgtggtatttacaattagagacctcgcccttgatggaaatccggttcagtgcgaagtcctgtgtaaacatgttcctgatatatgcagttacctgtgatacggtataaacacttgccatacgctatcctatgaaccttgcaagaatcccattgacaaaagcaggcgaatcattgccgccaaacttcttagccagctccactgcctcattgatggataccttctccgggatattctcatcatacagcatctcaaaaagggccagacgcaggatggtcagttccaccttgcccatacgctttgtcttccatccggccgccacctcgttcagcttcgcatcaatctccggtatcttatctattatgttgactgttcttgcctgaagatattcactgtcttctgattttaattctactttatgcaatacctgaaggacaccttccggatctgtgtcgtattcttccggggattggaaatactggtccagctgggccacggcctcctcctgggttggatagaagtctgccgagaacaacatcttgaaacagtgctcccgcaattctcttctggtcattttctcttcttgtacctgaaaagctcctgggcatgtccctgcgccgggcggcgcctggtctggttttataaatgctttcctcatgcatcaggccttccgtacattttcctttcttcaatgttggttggtcctcccccgataaaggaagttccgctgtagacattatagcaaaatcactgcataaaaacaataaaaaatgtataaaacactccccaggcaacgctccggggagtgttcttatccacatgactgagtgctcctggtgggatggagcactcgtacttcttcgggaaaatccggctacttaccctcttccatattaacgccggcaatcttaatgtttacatccagcacggtcaggcctgtcatgttctcaatggccgcgcttaccttatcctgcacctgctcgcttacagccggaatgttgtaaccgtaccggatgttcagggaaaggtccacggacacatgttcctcggtcacttccaccttcacgcccttgctcaggttcttcatgcccagcttgccgaccagctcattggtgatattgcctgccatggagtcaactccctccacctctgtggccgccagtccggcaatgattgcaactacctcgtccgcaatctgcacctcgccgatcttatccttttcgtataatttatgggtactgcgattttcctctgccatcacaaataacctcctgttaagacttaattaattagtattataacaaatctgcggaaagatgtataggattaatttccttagatatccagaacttgtatccagatattcataccctgatgttttatggaatggtgcggaatgaccgggtgagaccgtccggcttccctggacgccggacctgccgcttttcccgccatgtccgtgaagtaaaaaacaaggcctgcaaaacaggacttcctgttctgtaagccttgccgcagctataggttttgccgcattactgtactgccatatttaccctggcaggtttactccgccatattcaacaacgtaatgatgatctggtcagccccaacctctgccttacgcttcacgatatcctcaatctgggcgcgctgtgggtccgtgatggacggggcgttgatgacaacgtccaccttatcctgggtgatgctgacgaccgggtcagagaaaccttttgccatcaggagggtttctgcggcattttccttctcggaaacctcggtaagtttaatcatatcctggattgcctgctgtttggctgcctcgtcaatgcttgtgctgttaatgaggttcatcagggtttccttattctttgcacgtatctgctccctgctgagctgtacatttgctatgtaatccgccacactcatgccgctggtcagcactgcctcacccggattctcaagaccggtctgggatgccccgtcctctgcctgggccagctgtccggcatccgttcccgtatcagctgctgcctgggttgcttcttccacatcccctgcctgtgcaagctggttggcgtcggtgcctgaatcagcggctgcctgcgccccatccatatcgctgacagcatccaggtccgacgggtcctggtccaggctctgtatctcctgaagccccgcctggccattgagggaggccgcctggttctctgccaggatatcttcatccgagatgtccatggctcccgcctcatataccctgtttccatttgccagatcctttttgcctgcgtagttcaggtaccctgctgctgcaatcatcacggccagtgtggtgatgatgatctggttcctgcggaacagacgcttcatgttcatgtccttcatatgctcttttacctgtttcatattcttgatcttcatatcctgcactcctttatttattccaccctctttaatacttttattttatgtgggggaaggccaaataatgcttccattgcctcagaaatttcagcttttacggttggactgcctccgccctccgcgctgatgatgattccggacagttccgggctaagttccttctctataatggggctgttcccgcttgagccggagccggaaccggacaggaccgtgctttcctgtaactggttattcaccacatcacgggtgcctccgccggaatccttttcctgggtggtgcttgaattggtgctccggtccacatgcaccaccttttcgctggaggattttaagaccaccatcacgtctaccttccccaccccgtccacggatttcaggatattcttaatccggttctccatctgcgtctcataggaaccctctccccctgccgaggcagaggcagggtaaacgctgtccggaccagccccggagccgtcctggcccggtccattaagggatgcctggtccgctgcgcctccttggtcattttcctgtgtatcccctgtccaaagggggaccgcaccctggttcgggctgacctgtcctgcctggcttttctcatcctttccggtacttttactgcccggcaggggaaatgacagaatcatgagaagtacccccaccagcagcaacagaagccatttttccttagtcatctttccactgaactttgatatgcgattcttccagcccatagtactgtgccacctttcctgttaaatgctccaagccaggattaccgtcctgcttctttcccacatccccgccgtccttcaaagcgtcctccaaggcatcctttcgaatgtccttttcctcgttcttcccaccgctatcaccatcgtcctcccccagctccacaggcctgacctcaatgctgcccacattgcccgcctccacattcacaggcctgcttaccatgtaatcttccttcccgctttcctgttccttatcatcctttacttccatgcggatttctttcacctggccgtaagtgctgctgttcctgtccccgtctatctgcacctgtgcgcggacacaggtaaggccgtccgctgccgccatggcagccacatccgcttccactgcatcctgataccgccccagaatctggtccagacgtttttcatccatgttccacagacggctttttaaatcgctggcatcgttatggagggaaatggactggaacatggaggaaatctgttcatccagacgcattttccctgtaagagggcttacaaccaggaggatcagcaccatcccggcaaaaaagcggatgtatttttcgtattttgaatctgccaggagattgtttaccactgccaggaaaatcatgaagtatatgatatttttgacccatccgtatactgcctgcattggctcctccttccggcacgatagctatgatgcaaagtaattcacattcgttgaggcgcaggtgattgcaatggatatcatgaacaggaacatggaatacagcacaatctggatcagcattttatgtccctttgacacccctgagacacaggatacgatccgcttatcacacacgggctgcatcaccgccgccacacattggtacaggaccatcaggaccatcagcttgatgatgggaatgaccgtgatgaccgccagcaccaccacggcggcggcgcctatggtgttcttaatcaggacgcctgagcccagcaccatctgcgccatggcccctgccccctgccccagtccgggtatgatttctatcaggcgtttcattccagcctgcccggccgcgtccgcatagggcaggatcatggcctgtatcagatggaaccccaccaccaggcccgtaagtgtcttaaggctccagcccactgcctgttccaacagctcggtcagcttggagagcagtgcctccttcaccacatggctgcccagcaccataagcacataaatccgaaccatggaaagcaggaccgtgctgcacagccactgtatcagggttaccgctcccagcatcccctcatagagggccagggcgctcatgctgcccccggaaaatgccaccgacatgaagtaagcaggcatgagcagccgcatgaattccaatatctgatccagcacctgggccgccacctggaggctggccgtaaagctggcggccaggcaggtaaacagcagaaggtaggtcacgaaaaaacctgcatcggatatctgcccgcctttaaaaacagaagacacattggaaaacacggctccgatgattccgattgcagccacctggaacagcatgtgaccgcctttgcccacctcggagaacagggtattcctgatacctgcccccacttgtcccaggaccccgcccagattgcctttcaccagctctttcatcaggtcccagaaggagaaatcccccatgcctcccccctgctgtcccatgacctcatccaagaactgctgcatcccttccatttcctgctggattccaagctcctttgccccacgcatcagttcctcttctgaatcaccgctgtccgtgggactgccggacatgtccgtaccggcagcgctgactgtttcatctgccgtccaataagttctgtcggctccattccccattccataagcactgcccatcccatctcccgccgcccacaccgcgcccgccccggcgcctgccagcaacacggacaaagccaggacagccagtccctttttcagccatttccccatccttttcatcgcagaaatgtctccaatgtcccaaacagcgccagaagtatgggcatgctgattcccaggatggagagcttcccaaatatctctatctggtttccaagggaaccatatcctgaatccttacagataccggaagcaaattccgccacatacgttatgcctatcatcttaagcagggtcacaagatatacactgttgacctttatatagccctggatctgttccagtgcatccaggattgccctcagttttcccgtgccgtaaaaaaagatgaaaaagcctgccgccatgaccatataggcagcatactcccccttaatgccctttaactgcactgcaagcaggacggttgcaatgccggccgccgcaattgtgatgattgtcattctatccccaccttccctgaaacaggccaaagggccattataatgcaaacaggttcttcatggtttcaaacaggtcatatatgtaaggaatcatccagaacaataccagtacaagccctgcaaggcttgtaaggaatgcctgttcatccctgccgctgtgctttaatacctggcagatcacggaaaccaggattcccactgccgctatacgaaatatcagatttacacccatttgccgtctcctcaactattcttattccttttccttcaggtatgtcctaatacatcacaatgacaaggaacatgccgcccatgatacccaggctggtatacagcctgcatttttccctctggtttgtcctgagatactcaatggaaatatccagctgttccaggtacagcttcagcgtacgctcctgcatgtccacatccagatatcccagatgctcccccaggcctgccagctgttccaaatcctcctctgtaagagaaagccgtatctttggcgaggaaagggcctgcacctccctgcgccatatctcctgcagggattccccttcctggcggcagattccctccgccgcagcggtaaacagctgccccaatgggcctgtctcccgcttccccacacgctcaagcgcctccgccagaggtgcgtggctatatgtaatctcacctttcaggaaataaatcatctgccgcagcttttccaacagacggagccgttccctccactgcctggaagaccatatcccaaaaccgccggccgaaaaaagaaccagcatgcttcctatccacttcaatgccatgatgtcctccttcccgtcataaccgcttataatacccctttatcatatccttttatcacaaccgcctatcatgatcacttatcgcaacttcccatcacaacctcttaggaaccgtcccatcctcatataggatgcggctcctgccatcccatatacattgcacatgcccaggcccttccctgctgtcaagcaggatcagccgttcaaatgtcccctgtgccagaagtccccccatggacggcttctgcctgatatcctccagggagcttccatgtatggttgcggccagtgcacagccgcagttcctcacatattcaattgcctccgcgtcctggcggctgccgatttcatccaccgcaatcacgccgggagccatggtccttaccagcatcatcatgccctggcttttcggacagcagtccagcacatccgtacgcatccccaaatcattctggggaaccccctgataacaggccgcaagttcggaccgctcatccaccacccccacgctgaccccggggaccctgtccccggaatgcctcacccatccgtccgagacctgccgtattatatcccgtagcaacgttgtcttaccgcaccggggcggcgagatgaccagcgtattcaggaacctcccatcataaagaaaatccatcacaccatcagcacagcctggaacctggtgcgccaccctgatattaataaaagagatgaacttcatcagccggatatcctgcccctggaccaaggtccttccagcaaccccaatccggtgcccgccctggatggtcaggaacccctggcggagttcctcctcagccgcataaagggaaaagctgcccatatactcaaccgtctccttcatctgggcctgggttgccgccaggaacatatcccggtccaaattcccggtatcctgcctgaggcttccatccctggccaccaggaactcctggctcccacagatcatcataagcggcatccccgtcctcaggcgtatctcctggacctccttaaaatccaccggaacctgtcccaacacggacctcagttcccttggaaatagtttcaagatttcttccctcttcgccatctgtctcaccccttttacctcaatatatgagacatgcctgaaaatatgactgtatattaaaaatgaaaaaccacttaccccaaaacacatccccataaaacaccctcacccaaaacaaaaaaagtcccagataatcccccggattatccagaaccacctgacacttacatcaaatacttacaacttcttacatccgcctctatctgccgcctccccctgactcccctcccccataataataccacccaccgcccctaatccccagccattccacccctaatgaccggagtcccccagtctgcaggacgggccagggcgggctttgtcccatgggggcgggcgggggcggggaggtcccttcggctggcgggggttcggacgcatggtggagaagggagcagcttctaagatcctggcaagtaaaaaggcgggggtggacgaatgcatcaaagcatgagtccaaggtgctctgagctgagaaagtccttcaggatttctcagcgaatagcaccggtcccccgtctttttacttgtcaggatcttagaagctgccccttcggaaccctgcgtccgagcccccgccagccgaagggacctccccgcccccgcccggaacccatgggacaaagcccgtcctggcccgtcctgcggacgcacccccgctacctccccctcttaaccttcctgaccacctgccccgaccgtctccggtcaatccggaacacaatctgcatgaagcgggccacctcatcccatgcctccctgctctcaggtatcagatccatgctcatctggaacacatggaacatgccctcataaaccgaaacccggcgccgcacgccagcctgtctggcattctcagcggctgccagcgtatcgctgagaagcatttcatggctgcctgcctgtaacagcatggcaggaagtcccctgtaatcgccgaataccggggacagatacgggtcccttggatccgcatccccgatatacgtggaattataaagcattgtctccctggaattgccaaacagcgggtccttttcaaaattaaaatcataactgtcgccgctacatgtgacgtccgcccatggcgacatgagcaccagccctgcaggctgcggcagcccgtggtccctgaggtaaaggcacaaggcaagggcaaggccgccgccggccgaatccccggcaatcactatctgtcccgggcggtagcgtttttccttcaccagccactggtaggcatggagcgcgtcctccagggccgccggatacggatattccggggcaaccctgtaatccgcggtcagcacatccccgccaaagctgagacgggaatagcgcaccgcaaacttccggtatatgttcttcatgggaccgatatagccgcctccgtgcagctgcagcacggcccgtcccgtcaccacgccctcgggctttaagaactccattttaaatggtccattttcaataatctcatactcataaccggacgggcagacccaggcaggttccactggattcttcctgaattcgcctgtctgtatgggctttcctaaggaagtctccatgatgtcgtgtatcatatcacgcatcaggcctccccggatgcttaccttcttattccgcatttggtctcctcctggttccctatagatggaaccgtctgattaattcattcttcactcccctgtcccccaggaaaatggtcatggccaggatgaacacagtgagcaccactgtaatcaacgccataagcggctttgtgacaagccccgccgcccacaggatcagcggtatgaagctgaatatggtgatggcaagctggtacatgaaatagctctgccagttcaaacggttgacaagtatcaaaaacaccacagccacatccgcgaacaggatggtggcaggcaccgcataattcacggaccatccctcatagccaagcacccagtcaatcatgattagcagtacctgcatcccaaccgtctcgatgacaaccgttttccccagattcgcatgctttagtatggaataacggaccgtaagccctgcataggcaatcccgggtatggcgatgccggaccaccagagatggtcataggtggcaatattcaccacccccagcaccacggcaaccgcggccaggattccgtaaaatatataaaccagcttcttccacttattcttatcatattccacaaccgggtaggtatccttccacgcttccggtttcgcaagcccgttgctctccaatcccaccggtatcccggcctgttcaaggtgcccgaaaaaacagtcctccaggcggctgtccccaaatactttggtaaatgtaatattgacctttccctcataggcgcatacaccgcatttggctggctggcgtttggaaaccccgatgagcagatggaaattctcaatctcatcccggtactcctcatccatggtgatgggaccgatgttggacagtgtcatggtatgcgccctgtcattgcgcctgaaaataaatcccagggccagccatttgataaacaggggcaggatgcgcacataccacttcttctcattggacacattataggaaatggtctgttccagcttttccttcacaatattgtcatccatctggctgcagaccgcggccaggatggaatcaaaggagccgtcccccttctccccgtcgtaatcaatggctgtcaccgcaaagaaattggacgccgtgtccgagccgaaaaatgccctcaggttaatgggcaggttgatgccgattggctgcccgccgggcgttccgtccatataaacctggcagatggaccatatgagggaggcggtcaggtattttgtgacgctgactcctttttcacggcatgcccgtttcagatcctgtatatccacagtgccgtgcaccacgctctcaccgcccatggaaaggtattccccctccatcttgtaggctggtttggaactgtagcgtctgcccggcatctttttgtaattcttcagatagctgtcctcaatcttatagacagcccccggttcttcctccctggacggatgaggcgtgccccgcttcaggtcaagatagcgggcggtcagttcacggatgaaattcacggcccccatgccgtccgtgaccgcgtggaacacctccaggttgatgcggcggccataatagctgacccggaacagatacagctggttgctcttggggtcaatataacggcagggccaggaggtttccttttctatataaggcgtgcgtttgttaccttcaaagtaataccagaaaaacccacgcttcagtttcaccttgaatcccttaaacatgggtagggtatcctccagcgcctgctgaagcagattgggcactatatcatgttttaatatgactgagatgcggaacacgttgctcaggttttcattggcaatcatgggaaatatctttcctgtattgtcaagcctgtgccagcgcttcccctgaggatccttcttcatggcctgccttcttccttctgataaattataatgggaaaatgccctgtaagagacattgatttacacaacacagtattagtataccccaaagaaacatcttcctgcaatcattatctgttttcccttctggaaacatgatatactatggtcatacgacccgcatggaaatgtatatactatcagggataacagatggagcatatcagggatgtcagatgcagcatataagggatatcagacgcagcatataagggatatcagatgcagcatccgtatgtgcctgaacatgctctatcaggacgaggaggattacaaaatgaatgatttaagacaacggtgcgccgcggcgcgcaaactgctggaaaggatgccaaaggcagggcttggattctttcccacgcccttttacaggctttctaacctgtccggggaactgggggttaacctttatatcaaacgggatgacttcaccggcatgaacctgtttgggggcaacaaggtgcgaaagctccagtatctgattggggatgctgccgcaaagggatgcgaatatgtattcaccttcggcgcaacccagtccaaccatgccatgcagaccgtatccgcctgccgccgctgcggattaaaaccaatcctatacctggtggcaatcgtggaaccggacgaggaggacctgcgcgccaaccttctgttagataaaatcatgggcgctgagatacacattgtgaaaatgctgcccggcgaagaggaaaatgccgccgatgaacgggccgtggccatggccagggaacacatgaagcgcctggagtcagaaggacaccgttgctatgaagtgcccatgggcggggccagtccggttggctccgttggtttcattgaaggctatgtggaattcatggaacagaccctttccatggatttccatcctgactatgtgttccacggcaccggcaccggcgggaccatggcaggcctggcagcaggccgtgtccttacaggctcggacgcggcaatcatttccatcaacgtaagctggaaggacgagggctatcccggccgcgccggggcgctggcgaatgaaagcctgaaactgataggggcggacgtgaccgtggatgctgacagggatatccatacggacctgaactattacctgcccggatacgagattcccaaccaggcatccactgaggcgatccgtctcctggctgaaaaggaaggactcttcgtcgacccggtctatacgggaaaggcatttgccggaatgctggactacatccgaagcggcagggtgcctcagggaagcaacgttgtcttctggcacacaggcggggccacggccctgtttgcggaaaaggaaatcctgggcgccattgtatagttcctggcgcaggcatcctctccccttcaaaaccgcaggaaatatcatgaaataaattccctttccggtacaatataagtgtcttataaataaaaacacaaccagaaagaggaggatttccatgaaaacagtatatacccgcagcaccctgctgacaggaacacattatgaggccggttaccgcctgggcacacagtacgcagccatcccccagctgaagtcacatttcacagccggatacccgggctttgggacagaggaatgggaaaaggccgctgccctgttttcccagtggtgtccgggactgaatgaggaactgcagggggttgcggacgcccttcagacccggccccagaaccttgtctattatgccatgacctggctccgtcccggatgcagccacatttccctgctgccgtccatgacaaaggacggacacccaaaggttgcgcgcaactatgaattcaacgatgcatttgaggattttaatgtaatcaagaccagcatacagggcgcatacgcccatatcgggaccagcgtcctggggctgggcagggacgatgggttcaatgagatgggacttgcggtaaccatgagttccaccaccttccctgtgggggttgatgggaacatgcgccgtcccgccgtcaccgggcttcagttctgggccgtcatccgcacgctgcttgacacctgccgggacgtggccgaatgcctggagcggttaaaagacatgcccattgcatttaatatgaacctgatcctcacggacaaggccggcaatgcagccctctatgagacactggacgggcggaaggctttcaggaccatcaatcctgactccgacgcgcagtacctgtatgccacaaaccatccgctccttgaggagctgattccccatgaaccccaggtcctggagaactccctgaaacgctgcgggaacattaaggcattcctgcagcagcacggggaggggcttgatacggaagaattaaaacagttcctcctcaccccttacccggccggactgtcctgcccttattatgatgactttttcggcaccacaaaaagcatggtcattgacccggcagccgggaccatggagctttgctggggcggacaggaaggaaatggctggcagcattattccctggaaggagatttcacggaaggcgtcagggctgtaaaactgtgcagccagcctgctcccccatccctcttccaactgacagacaataaataaacaggagtttttcatgaattacgaacaatcactggaacaggccgttgtgtatattgaaaaccatctgggcgatgcactgacagtagaggaggtggcccgccacgcgggctactcctactaccatctgacccgggtattctcagccctgctgggcgaaagcgtgggcagttatattaagaaacgccgtctctccagtgcagccagggaactgctctacacggacagacggattattgacatcgcggtcagccatggctttgaatccagcgaggcattcagccgcgccttcaaatccgtctatcacgtaagccctgttaagtaccgtcagaaccgcctggagcttttcatcagctccaagccaaaaatggaccagctcatgctggcccatctgacgaacaacctgaccgtccaccccaggatcctggagcttcctgatataaaagcagccggactgcgcggcttcaccacacttggcgataacgtgattcccggactgtgggaaaccttccgcgcacagatgcacctgattcccaacacatttgcggacagccgcggctttggcatctgcgaggcctgcgaagacggcaacaacctgtataccatgaatgataatgtgctgttcccggaggtggccgcggtggaggtctcctccttcgacaaccttccttccccctttatccccaagatcctgaagggcgggaagtacgccgtattcacccacacgggaagccttaaaagcctgtccctgtccttccggtatatctggagcacatggttcctgacaacggatgagcagttggacgagcgggaagactttgagctgtacgatgaacgctttctggggtacgaccacgcccacagccagattgacctctatatccctgtgaaatgaaggccggggcgtccttccatcctcctacttctccatccttccaaatgcctccaggaaactcagcttctcaattgccttggatgccatccaccagttctcgctaatcgcgaattcctttggatactcatcccccaggccaaaccatgtccatgtaatattccagacgcctcccggatttcttgtatccaccaggtaatccagctccagattcacaacctcctcattcccaggataaaagggacattcaggcgaccagatgaattcagacggcctgggcgtataggatgcccagttatccggattgcgctcaatggaacggttcaccagacctggcagggcttcttttatggattcacagtcaaagcggcggcccagaccgcatgcctccagctcctggaccagcatgccggtgcctcctgcccccatttccccaagatcctctgtccgcttcattttatccagtatccgtccagcgtacccgatggcctttgcataaagccctgactgcctgtccccatggcgcaggataaatgtacataagcctgctgagattcccatatcctgcacccggttgacggactcatcatatgtcatccagggcgccctgggataatcatcattggacgggatactgaaattccagccgtcctccgacatatgcaccccgctgtcaaggtagttaagcattccttttatgaccgggtggtcattgtccgtaaatccaatccgcctgagtattcccgtgacaaccaggacagcgtaaggcgaggactccgtattccagcaatccggctccaccgcatttccaaatcccccgtcctcattctgataaaattccagcatttccatgatgcgttccctggtcccgccttcaaaacagaactgccataacgccagttccaggggccgtgcattgcggtatatccaggtgcgtacttccctgtatgctgccttgcttaatttcttcatctgatacctccgaatcatgtttggaaaaactatatcataagaggatgcatctgtattgaaaaaaaacgacatccggtatcacggcatccgatacaccctggtcctccgtgcaggaacagcacgaaaaacagcgttcagacccactccagagcggactgccttgcctggtccggccagacgccgtgaaaccgtctgaactcattgagcagatgggactggtccgagtatccataccggtacaccgcatcctgaatccggaactccctttgtcccactatctcccgccatacattctggtaccggaccagactggctgtccgcttcatggaaatgccgatgtcccgttggaaaaggcgttccatctgcctctggcccacacaggtgtggccgcataattcttttaccgcagcatttccctttgtcttcaggatatagtcaatggcattatacaggttgggattatattggtccggcttcagcttttccagcaagaaccgttccatccatgcaatccgttcccccgccaaacggtaataaagaaatatatcaaaaccagccgtgtatcctggctgcaccagttccaggtcccacacctggttatataaatccctgaaatccaaatccagaaacagcctggccgcccaaaaataaaacctgaccgcaaagctggtcacctcatccccggtcaccctgtgcggtttaaacacggaatagtcctgtaacccgcacagcctggtttttacggtctgtcttgagtggttgatttcaataataatgtccatgcaggtgtccgggattacccgcacggcgccgcccttcccgctgccttccatggcccagaaacaggcgatataggggcgcagggcagggcagggtgcatattcagtataagaatcatcccttaaaaagggccgcgatgtcaatgggcggtatcgtgtgtcaaatgcaggtatcatgaagcgtattccttttccctcagactttgtcaggttcagacacgctctagtataagccatgggaccgttaaatacaacccatatcgcctgacgccctctccattgcctcctggccctgtcctatttccaaagatgtcctcacataaaattcctggccgtcccttaccctggcattggcctcagcctttccttgcggacaccgtatcatttcctgcccgcagagacgtttcacctggcttctggaaatccccagctgtttcgcaaacagcgtgtccagccttggggttatgcatcctcccagcttaatctcgatttcatcccatccctcatgcctgcacggcaccggggtatccaccgcctgtaccgtatacccgctggacgcaagcgcccactctgcccggttcctggcaaatatggccgggctgcttccatattccgctgccagatgcatgtcattgtcaagaaaactcctgtattcctcctgcttcagacggtccggtcccacccgttcatatatggtcatattccaggatgtcccgcacgtcatgcaccggtaaatcagccatacatccagcaggcgcccgtttgcattgacgcggaacttcccgctgttcccaaactccgttttcttcccgcatttagggcaccgtcttaacaccaccggaagtgattccggcattatgatccattttttcctgatattctgtttcatctcaaatctgcctccgcagtccactctatcatccgcggacccggatataaacctcaaactcaagccagaaacaaggaaaaggcagtgtatccgctattccggtacactgccttgtttcccctcattctttttccgttcctgaagcacaatcctctgtatgcttttttccgacaggaaatattgctttgccaggtccttcacacccaatccctgactatattttacaaatatttctatatttcttgactgaagttcctctcttgcccgggaagcctctccccagccctttttattttcctgctttctggggatgtatacatattccccgtcaatataatcctgaatcaactccaccagttccaccggaagaatctcatttgctttctgatagcgcatcgctgcctcccaaacatattctgctgtccggaatagcaaaggctatacaattactctgttttcactgcatcagcccatgctatgcagcgataatatatttcctcataaaaacagggcctccttatcatgtttatccattaaccattggcttgtccattatatcatggaaaccgtggattaaaaacctcacgcattttacagaaacattcttaatcttcttttaatcctgcggaatctgtgaaatgacccagtccgtatacgcctcaccgatttccaggtccatgttcacgtcaagcctgctccggatgctggttacctcctcatccttcaccggattatatcctttcttctcataggatgagtagtataagcccaccccgcgcttctgccagtttggcagatcattgaaattgatattcctggaaaacaggagttcattcttaaatgcaatggtctttccctcaatctcccttgtggcttccctggcagacatgccctccctgcgcagaagccagtaacagtgggcattcagggagttcctgtgggcatcctcctgcctccaggaaaaatagtccttcacgcattccagattgggcagcggcaccaccctgcagtcaaagcaggccagtacccccaggcgcagtgagaaaaatgcgctggcctcccctgccaggacagaattaatcttccttgtcttcctgccaaatgtattgtcccttggatggaacagcagggaaatctcatcactctgggtgtagccgtacacaatgcgaaacccacagtccatcagatgcttcaccgtatcaaccatggcatccctgaaccggatgtcaaaaggcgcctcgaaccggcaggtttccttggtcagctttgtaaaattcctcccgtcaatcctcaccgccatataaagctccggaaggatggtctgatccagggaagtctcaaacctgcgcatgcctgtatctaattcatcaaaaatcattgtctatccctccatcttatcattccacacatcaaccacgaatgcatcatcctggatccgcacaaaatacagtacgtcgaatccctccccataggagggaagttccagacggtttgaggtgcaggcaatcgccctgctgggaatacacgcctttccaaggcgctgggaattgcgctccacacagtccctcacaatggactggaaaaagtatccttctatccggtatccatgctccctggccgcctttatgtaccgattcctgtcctctgcggtgggatttgtattgtccaccacaaacgatacccgtttctgcaggcactcctctaataacgccgcctccttgttcctggtgtgcagcgtgtccagattgatatgtacaaaatccggcgggaaatgctgtttaaaaaaagtagatttcccgcttgcctgaataccggtgaaaataacggctttgggcgcctccgcctccagcttgtgctccattgttttccgtcctcctgtcattatccggttgtccatggtccatccaggctaaaatttcctgctgatgatgaacgtaagcagcgccaataggaatatcagcaactccttcagagggttttcggcaatatcatccaccagctgttccaaccttgtcttcctgtgattctgccggaccttctgttccagttcctccatggtcatgacggcccggctctgctccgcatcatagcatttccgtctgtccgcatccgacagtaccatgtaagcctccgtcagctcctttgcctgctggtcgttgaacgcccggccctccatctcataccatcgcttctcccgctggaacgcggcgtcgatttcttccggggcagcgtccggattcaaatgcaggattgtatagtagccgttctttttcatgtgtcctcctaataccagggatgtcccggcatcagtccgggactgccatccacacctattcatccatccctgcggctgatacctgacaagcgtccaaaaaaggggataagaagaacctttcagaatgaatcagttcatgattgcatccgtaattttatccagcggtatgccagggctttgatgataccgggcatacaggaacctcttccccatcctcccctgcttcctcccaagacaagatatcatagtccccttttgctacctgaaccagttccccgtccaggatactgtatacatcgtccagatagattaaatcaaacgaatcaatttcccttagatcgcaggacccaatataatctatgtacgcctttttccataaatcccctgtatcccactgctccatttctgcggcttcttctgtatatgccactgtggaaatacctatttcctcttctttctctgcattacccccgcaggaggtaaggatgccaagtgtcaggatacatgggattacccgtaaatattgtacatacattctccggcaccgcttctttccaccaataaagccgttttccatcagcacggtcctccccgctacttatggtacggttccccggccataatccggtaactcctatatatctgctccagcagcaccacccgcatcagctgatgcggaaatgtcatctttgaaaaactcagggcataatccgcccgccccatcacctcatccgacaggccaagggaaccgccaatcacaaacacaatatggcttatgccatccacccccagcttctgaagcctggatgccagctcctcactggaaagcatcctgccttcaattgccagggcaatcacataagccccatctttaatattagaaaggatgcgctgcccttccttatccttaatctggcgttccacggcctcactggccccatccggcgtcttctcgtcctgcacctggacaatatccagcttgcagtaacggccaagacgcttggagtactcctttatggcatcctcaaaataccgttcttttatctttcctaccgttacaagtgttatcttcatccgttaaaactccagtaccatgtcataccacacagccccgccgtgaactgactttgaaacacccatattcacatacccgaacttctcatagtaaccgataagcctgtccttgcacgtcagtataagccctttcctgccctgcttccctgcggtttctatcatggtctgcataagccgggaggccacccccatatgccggtacccttctatcacatccagcccgaaaatactctggtacgcccccttggggtcatgcagggaaatatcctcaaacatctcatctgcaatcgtcctttcatctgtaaccgcgccattgatgaaaccaatgatccgcccgtccgcttccgccaccaggaagctctccccaaatgcctccagacgcgcttttaaactttccctgtcagccgcctccgctgccggaaaacaattaagttccacctgtgccacctgatccaaatcatccggcaccgctgtcctgattctgtatgcatcattccctgtcatctgtatgtcatcctctcagcctacccggccatcctctaaacccatccagccatcctctaaacccatccggccatcctctcagccttttctcagccctttacgcggaaatagtaaccaacgccccacttcgtatgtacatactttgggtcgcttgggcttggctctatcttttccctcagccttctcacatggacatccacggtacggacatcgccgctgtccatggccttgttgccccacacataggtgagcagggcttccctgctgtataccttgttgggattgcgcaccagaagctccagcaggtcaaattccttggctgtcaggttaatctccctctcgccgataaataccctgcggctttccgtatccatcttaaggtcaccctggccaatgacgctgttgttggcttcctccttcttcaggcgcttgttcttggaactgcgccgtatgatggccttgatcctggccttgacttccaggatgttaaagggcttgcttatatagtcatccgccccatactccagtccaaggatcttatccatgtccccgcccttggcggtcagcatgatgatcggcatgtcggaaaactcccggatggcctggcagacctcataaccgtccagtttgggaagcatcacatccaaaagcacgatatcgtactccgtcttcttagccagttccactgcttcctcgccatcatatgcacaatccacttccataccatcctgttccaggctgaagcggataccttttacaattaatttttcatcatctacaactaatactctcggcatgttcattccccttatctatcaatggcggcccaaatcaaacctcgggccgcccaactcttttatactgtgatactgtccttaatcttttcaaacgcagcgtccttgatgccggacacattcataatatcctctatggactggaatccgccatacgtttccctgtagcggataatatcctctgccctggactccccgataccgcgaaggctcataagctcctccctggtagccgtgttgagattcaccatggacctggtctttgcttcaggatccgcagcgggcttgatgccctgtgcctcccactcttttacctggctctcactgggaacttccagcttcataccgtccctcagcgtctccgccaggttcagataatctgccgctccgccgtccacaatgcctccggccgcctcaaccgcctcatataccctgcttccctccggaaggccgtatacgcccggctgtcccacctctccgcagacatgtacataaaccatggcggcagatggttgggtggaatccggctgtccggaatcaatctgtcctgaatccgtttttcctgaaccgctctgtcctgaatccggttttcccgaaccgctctgtcctgaatccggttttcctgaaccgtcctcttccgaatccggctgtcctgaatctcccaaatccataacaattccttcatttccggaatcaaccgcacaatccggctgcccgccgcaactataacatatgcctgcagccaacatgcatatgacgatggcaggaacctttaatgtttttaaagatataagtctcatctgaatggtatccctcctttatacgggtaccatcccagcctgatagtactattctaactgttagtctatttaaatacaagagttatttccaatttttatctttcaaaaacaatgattccgccgatggcaatggcagcgccaataagcttatgccatgcaaatgggcttttttccacgccgaacataccaaacagctcaatcccatacgccacgataatctgggagatgacgattaagagggctgtctgggcaggtcccaggctggccatgctgcggatgaccgtgtatgtgatgagcgcccccaggatacctcccaccataacatattttggcgttacctgcatcagacccgcaataggctcccttcccgtaaaaagccagattaccacacaggtaataaacgcggtcagctgtacccagcccgcagccacccacacgctggtctgcttggtaacctccgtattaaatacgccctgtatgctcattaatgcgcctgacagcaatgctatgacaaatcccatatcttttctttcctgcctttccattatttttcctgtttctttagctttccccttgaatataattttattctaagtgaaggagttgtcatgcatctgcatatgatgtataatcgttcccacaggaggcactgtctatgagtaccattgcaaaggctttattccagatgtcatcgtggcccatgaggacacctgttccatattccggcttccatctggtttttggaggagccggcatccttgccgccattttcctggcatggaaactgtcccggagcaggcatctgcacgtcctgtccgcctgcggcctgatcctggctgtcagtgaaatttataagcagggattcctgtattatattgtcaacggggaacaatatgactggtggtattttccgtttcagctgtgcagcatccccatgtacctgtgcctgctgcttccattcatcgggccgcggatgtcctcccgtccagcaaaagcagtatataccttcctgcaggactttgccctgttaggaggcgtcatggcgctggcagaacccagcgggctgatgcatccgtatcttgtattaacccttcacgggttcatatggcattttatcctgattttcattggactttactgtgcatttaccggtaagggcggacgaagcctgtctgactttggggatacgctgccattattgtgcgggtgcgctgctgttgccaccctcatcaatgtggcatcccatccttatggaaatgccgatatgttctacatcagcccctattaccccaacggacaggttgtctttcatgagattgccctgaccatcgggacggttccaggtaacatactgtatcttttatctgtggccctgggcggttttctgttccacgtcatgctcaggcatatcccacggcagtcttaatgcccgctgggatcatattacaaaaaacacggttatattttataataaggagatttgaatatgtcaaagatatcaggaaacgaaagagcaaaacaggcaatcgcattccatgacaggggcttcaactgcgcccagtctgttgcatgcgcatttacggataaaacagggatggatgaaaagaccctgttccggataaccgaaggacttggccttggaatgggctgtatggatgcaacctgcggggcaatctctgctgccgctgtattgtccggcctgaaatgcagcaccgggcatacccaggcgccggattccaagaagatttcgtatgaggcatccgcctcctgcctcaaggcattccttgaaaagaacggcagccttacctgccgtgagttaaggggtgaggatacagggacaccgctgcgttcctgtcccggatgtattgaagatgcggttcagatcattgacggacatctgtttcccgaggaataggaaaagctggctatgataaggcgaatcagaagttgcgtttggatgcctttggcgtaaaagacgggaaaagtgccggccaacggattggaactcatgaactgaaacaggagcagcagtgtagggatgaagaaagtgccatatgatttattccggatagagaatgagataatagagaaatgcagtatatctgtaaaccgtttccataaggtcagcagcactcaatgggaaaacatatatcaaacgattgcagaaaaatatgccgacaaaacaggaacatggaaaaacggtttacattgggctaatatcaaaggttacagtccaaaaagcatgaaaaactttttagggagttttccagttgatggttcaacatggttttatctcctgccgcagatcatatcaggggatgagatggtttattttttaattgacaaaggcagtgattggtatttgggggaaaagttttggatatttgaaagctatgtacctgaattagcagaggcgcttaatttgttaaatcaaactgcctttttagataccggatgggcggactattatattatttcaaaaaaattccaatggcttataggctttaatcaccatgatataatttcatgtgttggagaggggttaaatcttaattgtctcaaaaattaagtaataaaacaagttccggtccgtcggactaatttgctagggtgtgtttgaaaattgctttccgtcggctgtgcgtcccactttgtgggagatttggtcccgatgatggaggcgtagcgggctacgctgactgaatcggggccaaatataccgcgaagtggggcgtgctttgtcctaagggggtacctctggtggattccttagggcagacggcgggaatgaattttcaaacaggctccggggcatacctgcaaattcattttaaataaagttgtctggatatcagatgccattcatcagttggcattctgtatttttatgaactgcatgaataaatgaatcagcggaatgtagtttgtctaccgtttgaaagctggcttcacttagcattttttctttatccggcattccttccggctttcttttttcctttttccttaataactcccttttttcagcagcttgcgaagataagcataggttgcctcttcgcccttatccttcagcatgataagcagcttttccagcagcgcccttgttcttggatggatggtgatatactttttggtatattcataatattccagcggggccgcgctggtgtagtcctttcctttatacacttcgcaggccgcaatcctgtcgcatatcatctcagccacatacctgaccggcattttgttgcccaccagtccctcttccttgtggttggaaatatcaatccagtactcataatggtgcttattcctgcctttgtggtgcagccaggccctggaataccccacgtcctcccgctctgcagcgttcgggcttctgtcgccctggtagtaccggacacccgtccagaattcctcagggctgtacttggaaagatcatgtgtcagtccctgccaatacaggccgattttaaaacagtgcctgcgcaccaggcgcctgtgttttgtaatggtgcagtaatgcctccatatattttgaaccttcattcataaatcccttctttttttaccctttatgccagttagtatatcatataattcacccttttgcccttttttcttcatattttaacctttgaacaatagaatctaaggtttgtataaattgtttatgctttatcaccaaaaacgtttgacacttttcaacatttgtgatatcctaaggacagttgcgaaataacttgcaacagaacaatttttttatattttttggaggtatcgtaatgaaaggtacagttaagtggttcaacaaccagaagggttacggatttatttcagatgagcagggcaacgatgttttcgttcactattcaggtctgaacatggatggcttcaagtccttagatgagggcgcagaagttgagttcgaagtagttaacggagctaagggtcctcaggctactaacgtaaccagattataatcaatgaacaacagtgtacctttttcaaacatatatcatcattgatagagttgaagtaagttatatctgatttcaaatgattacaagtaagagccagtcttctgactggctcttgttgttttctgtcctatatccgtggaatcagtgtcttccctccatgtcttccctccgcgccttccctttatccgccatccaatcctacctggcgcgttccagtatgtccttcaggtcgtcggttgagaactcatagtgctttccgcagaaatggcagttcacctcaatgggctttccgtcttcaatcatttcctggatatccttttttccgacactgattaatgccttttccaccctgctcttggtacagttgcagtagaactgcaccggggtcctgtcgtttatctccagcccaaactcaccgaggatgtattccagtatccgctccggggtgttgcccacatccagcagcgtggtaatggaggatatctccttaagcttgtcttccagcctgccgatgactgactcggatgcccccggcatcagctggatcatgaaacctccggcctgacgcaccgtgttatccttattcatcaggacgcccagggccacggaggaaggaatctgttccgatgtggcataatagtaggtaaggtcctctgcaatctccccgcttaccagaatggtctgccccacatatggctctttcaggccgatatccttaatcacactcaggacgcccacgcccagggcgccgcccacatccagcttcccctttgcattggggggcagcatgaccatgggatgaaaggcatatccttttacattcccaagggaatcagcggtcacggttagtccgcctatgggtccgtccccctgtatcttcagggtcagaaggtccttttcccccttcatgtcaatccccatcatgactcctgcggtgagaagccgtcccagtgcagcggttgctaccgggctggtattatgggcctttcttgcctcttccaccaagtcccttgtggtggaggcaaatgcacggatttcaccgtccgccgcagttgctcttatcacataatctgacattgtatctctcctatcctattttccgttttcccgcgcaatcacgtaaatccgttcactgtcctgctgcacgggattccgggtgcaggcgtcatatgccgccacaaactccatcccagcctcactgactgcccgccggacctcgtccagactgtatgcgcgctggtaatgggtttcctcaaatttcctgtaaagctccccttccttcacaaaaagggtcaggtcatattcattgaccttgtcttcctcatcataaaaattattccagataaagctggattcttccctgtcctctgcaaatgtattgtcagccagcatttccctgtacttatattctgtgttaaggtcaaaaataaatacgcctttggggtccagataattgttgaccaaccggaacacctccaccagttcctcatattccatcatataattcatggaatcacagatgctgatgacagcccttaccgttccatacagttcaaaaccgcgcatgtcctgcagcaggtaaaggatatccaatcccgatgcattgcgcttgttcatggctatctggagcatttccccggaattgtcaatcccgatcatatcgtacccggaccttgccataagctcggtcaggctgccggtcccacaacccaggtccagcaccagtccatccgtgacctggtattccttaagaagtcctgtgacatagccgcaccactcttcatagggtacattgtcctggaatatatcataaacctccgcaaaaccagtgtaagcctccatccttcatcctcctgctttccatactgcaaaagcgcctgcccggagcttcctccggacaggcggcttacaatcagacgtcctcagacacatatggatcctatgcgttcttaccgcagcacttcttatacttcttgccgcttccgcatgggcacggatcgttggggaaaactttctttcccttgcggactgtgccggaagccttctgcgccttgtaaagctccttgcgcttctcaggcgtaaggatgctgtcccactgtggaagttcaaacagccagttggcctttgcctctaccatattgtaatacagcttctcagggtcaatctcaatcttgacctgggtgtcctcttccattgtctcaatcgggttctcgtatcccttaagactctcattgattccatccaggaatccggtcatgatcaggatttcagtctcatacttctcagccagttcttttacggttccggtaactacttcccctggattgctgaggatctgctcataaattcctttttcaatctgaaaatatccagcccacaattcttctttctttttatcatccaggccgtcgccatacgccagatttctccatgtctctaacagtgccatagtaaaaccatcctttttgtattatttatgtgctagtccatagtatataacaaaagtaaagatttttcaaatatattttacgctttacatacttttcggttttgtgcagataataaacatgtaatccaatcaaaattaaaggaggtttttccatgaaggtaaatggcaaaaacgagagcattgaatgtaccatcaagaactgtacgttccatgaccagaaagaaaactactgtaccctggacaggatcaaggttggcacacatgaggcaaacccgacacagaaggaatgtacggactgtgagtcttttgtaaacaaggctcagtaagtcaggaattgggacaaaactttggccgcataacggcagggttttgtcccagtttttatataaatgtggataagccgttttatttttcagataataacactttatccacaatcttttccacattattgtggataagtggataattcgtgtaatttcgacaaaataaaagtacccctgggcgcgagggacagtcgaaagaatgtcccatcgcctcccgcggcgtacttaacatggtttccgtttggtattaggtcccattccttccctgcgggagttatgggtctggttctggttttccggtttttgtttttctgttatgctgttgaacatttcatttgatttcttccttgcggccttttcttctaaatccctgtccattatcatcacctcaatgatagtatggcagggacaactgatttccactccatgatgttcttgtaattttttccatttgtgctataatatatctcatggggacatagctcagctgggagagcgctgcgttcgcaacgcagaggtcgcgggttcgaatcccgttgtctccattatatgatgtgctgaaggccttgatttttaaagggtttagcctattttttttgctttatacagcctgactttttgaataaatttgaatacatttgctattagccgttaatattgagttgttttttattttttttgttatatcctccctgaacggattataaatatatttaagtgtggtttccaaatccgtatgccccagccaacgtctgatctcatctagcgcaatccctgatacattcatccgagatgctactgtccgccttatacaatgcgatcctttctctttctcgaacccgattgctctttcagcccgcctaagtttatttaggaattgaagcttagtcttccgcgcccccacttcattacagaaaatatattccgaaagaacttggctactattcttaattaatttaagcatattaataacagaatccgttaagaccaactctctatatcccgcttcggaatctgactttacatattccactatattaccagaactgtcttccattctttgaataaaaatcgtttcatttttccagtttatgtcgctccatttaagagcacataattctgcttttgtcaatataagtctaaaaaaaatttgcttttaattcgcaaaaagcaccactgttttcatccagtgatgctcctgcgaacaatcttattccgtttatgctttttcttctttgtagaaaatgtcatccatcttccagcttatctccatacgacctggttcataaataaagactttctcaataatctttgacagctgtattttgtcaaaatcctgcaatgctgcaatctcatttacttccatttctttttctgttgcttcatcacattttttcttcgctactgcaatctcattctccaattctgctatctgcaaagtgatttctgaaatacgggaagtcgttttttccagttcttccatatacccttccttgtccaacacttctgaacgataatcagaatacagtttcatttttcttgacgagagtcgctttttttcactttccagtgttgcgatattttcttctttcaaaattgttttatgccattctcttttctttttctcaagattttccgaaatgaattgtgccatatttctggctgcatccagtactgtttcttctgcttctttcctgtccattttactttccgcacacccactaagaccgctgatatgtgcctgcatacagcgatacccagtctctctgctggtaaaaccaagtcttcttccacaggtcgggcaaaagaaaatagggcaggctactcctctttttgcaagaacttttttctggttagtaaacgctttctcatttgctttccggaataattcatcggatataattggttcatgtgcattttctacaacaatccactcctctttatcattggaaaccaatttattgcttcctgttcttgccactctctttttattccaaataatttttccaagatacacttcatttttgagcatatctgagattgtcgtgactgaccagagtttcttttctttttcgttttctctgtgcatttttataccttttctgcacatatactcccggcatgtaagcacatgggtttcgttcagatattttgctatctgtccttttgttttcccatctgccgccattgtgaatatcagtttcactatttcagccgcttctgggtctataaccagatgatgcttatcttctggatctttaatatatccatatttgggaaaagccggcatatattcaccgtttttagcatgtgttttcatagcagaacgaacttttctggacaaatctttgctgtacattgcattcagcatattttttaacgctacactcattcctccagtaaaaccagaggaattgatactgtcaaagccatcgttaattgagataattcgaataccaaggactggcaggattttttccagataattccccacttccagataatctcttccaaatcttgaaaagtcctttataacaatactttttatacgtcctgcttttgcatcttccatcatcctctgaaagccaggacggttaaagtttgtaccactgtacccatcgtctacatattcaactactggacagttagcaaattcgtcctgttttttgataaattcgtttatcagcattctctgtgcactgacactgttactttcggcttttatactgccatctacatcattatcctccgacgaaagtctgatataaacagcgatacattctgttactggcataactcagcctcccgttcttttgcatattttcttaattcttccaacatatcatcatacaccaaacgtaccgtaatagaaccgctttcatgtatttcgattttttctacaaaagcattgaccatttcctttgtcagcgttctcgtattgcggtatttattgatcaatgtttcccattcttcctctgtgtgaaaatttttttcatatccaacctgatgctttaataaaatttccatgttattctggatctctttttctgtttccgcatcctgctttgaaaatgtttcatactgctctgcatcaataatacggcacacataatcctcaaacaatctttcccggtgtactgccactttttccagttctttccggcatttcttgatttccctgttaaacacatcatattttttaatgctttcctgtctttgattcaaccgccgaatcaaatctacattttcaacatatacattgatatgtgcacgtatcacacgcagtacataatcattcacttccaaatcagtgatagaatgtggcgtacacttcccgtagagcttattatttccacagtaaaacctacgatgattgccttttgttttcccatataaatacatggtttttccacagtctgcacatacaattttctgcttgaaaaagttgaagtctcttacattattgccatttgatttacgagcttcattaacccgttttacgatatgaccaatcttttcctgtacctcatcaaaatcctttctgctcacaagtgcctcatgggtatttttgatgatgatccattcttctttctgattcattttctgtctctgtgctgcccaggaatcattggtaaactgattatgcacactatcaccggcataatattgattctcaaggattttgtggactgttcctccactccatgtccatgtcgctgacttttcatttgcttttcctgctttatccagcttgtaggctttcgggcagagatacccatccgcatttaatttccgggcaatctctgcataagtcattccatcaataaaatactgaaatatctttttcaccactggtgctgctaccggatctggaatcagctgatgaggattatccttgtctttttcataaccataagccatctgaccggaaggaaattcgccatttgcccagctcgtccggtatgaacttcttattttctttgccaaatctctggaataaaactcattatacacgtttgacatgctgatcagcaggcttatgtcatctctgaacgaatcataatgatcattcaccgaaataaaacgcacattaaagaatgggaacactctttcaatatagcttcctgcctctacataatttcttccaagtctagaaagatctttaacaataacacagtcaatatttccctctttgatgtcctgcatcatctcattaaaaccatctctctcaaaattagttccggttttagatatatcataatattcctttgcaaccacgatatctttctgttcttttacgaaattatgaagcagaaccatctgcgtttctatcgtatttctttctctgttcttttcactctcataggaaagccttgcataaagggctgcatgtgaaactttttcacactggttttcagcttctgtaaccaaattttctttatttccaacatttacataatctacttttcttgattttcgagccatttatacgacctccctcttttgaatttctattcttccgtccatacctgtgctgacatcgcatcccaccgactgtatctgccgtaacagagattgataacaatcatcaaaattaaatctgacttcaatatgttttttgtcatatactaatatctggtcaatcagttcaacagcaacagttcttgtaagttcctgtatattctgatgctcggcaaaataatcaagccaatgatatttatcactttttgattccaggacttcactgatctgttgatcaatgcttcggactgcttcctcggcttttttccgtttttctgtgtacccgtcatgaagctctttataatcttcttttgaaatgattccttcacggaaatcctcatatagataatctcttaactcccggcatcgcacggcttctttttcttttgcttcttttctaatttccagttcttttatatccaattcttgaaatggtacttcatggataaaatccatgatttttttcatatcaaggatattctcaatatggatttttaccagttccaatactgtttcttctagtttacccattggtattctgtgtgctgcacacgctttcgtagccgcatgtctggaacagatatagtaagcgtatacctttcctcctgccggaacatcccgtttgatcatcattgccccacagtctccacaaaccgcaagtccagataatggatataccttttcctcgttcggagaagtccttgtatctatccctaataatctctgcaccagtgcaaattctcgttctgatacgatagcctcatgatttttttcaattctaacccaatctgtctccggctttttcatcaatttttttactttatggtttggtgttgttctttttccctgcaccagagttccagtgtatacttcattttcaaggattctttttaccgacatggcgctccactctgcctgttcgtgtgttttaaaattatcctgaatccttattccaagactgtgcttatattccattggtgaaagaacaccctgtttgttcaatgcattggcaattgctgtctggctcatacctgataatttcatgcggtaaatttctttgacgatacctgccgcatatgcatctagcaccagtttgtttttattatctgaatctttctggtagccatacggtgtaaacgctccaatatattccccattttttctctttacttccaggtggcttcttattttgatagaaatgtcacggcaatatgcatcgttaatgagattcttgaaaggaatcacgatttcgtctgcctgacttttcccttccaggctgtcataatgatcattgaccgcaataaaccgcacgccaagtgccggaaataatctttcgatatattttccggcatcaatatactcacgtccaaaacgggaaaggtcttttacaacgacacaatccacaattccttttttgatatcttccagcatcatctgaaatgcaggacgttcaaaattagaaccgctgtaaccgtcatccacccgttctgatacaacaactatatcctttttatcttttaggaaattttttatcagatctttctgatttgagatactgttgctttcacgctttccagcagtagcaacatcgccatcttctttcgataaacgaacataaatggctgcatgatagattttctttgaattgttaatttgattcatcttcatcctccttagttttacctttccatcaacattggtaaaacccagagggtgagtcgattttgtcctgatatgaatgaggagtcctgaattcctcgtctccatattaacataactcttcagattttaccatcactttttatacagaaagcaaaagttcctcaaatgcatcttcaaaagatactccattgtttgcaaaccttattttcacttttacatttcctatacagacaagatagggatttcccacctgtctgagatattgagctattcttttttccttcgtctgattccggtcaatccttatttttcggatatccttcaattccttcagatccacatcatcaaaatccgtttccagatagtttctatattcttctgccgtcatgcacttctccttccattcccatctgaatccgtactgctttcagtacccgatccaggatccacttatttactcttccgcatttctcaataatacattttgtggaaatgctcataacctgttcagccagtgccaaacttccttttcggattcccgtcatatcatatttactgataaatacatgtgttggcaaataccgtttcttatatattcttgatgtcagcggaactaccgttatgactgaactgtatgtattggctttattattgctcactacgatcaccggtcttacaccaccctgaacagatgttgtaggaaacataccgagatctgcccataagatatctcctcttcgaatcgtcacttgtcatctctccaatctttttttatttgtaaagcattcatagcgctatattggctccacagggatacggcagagttcctttccaagctggaaagctctgccgcataacctctatagccaatttgattattaaacagtgctcgctcgattctatttatcctcgataccccgaatcgttactcctgcatctgcaggaagggaataataacctgtccggatgctacactccggaccacaacccaaaaactctcatttccaggctctggcagttcataggtttaccagttacagacttctcagggtctgcaagtgtatcgcatctcacacatgtcctcgcatcaccagcctgccaactggctttggtcagtgctttttcgcagcattattagctctaaaaatgtttttacgtcttataatcctatagcggcatcttcctcgtgctcactgtatgaaatgtcacgtcagttattattggatattcagttatcatggtgcaatttagggagtccttaaagctcctctaattactaaagtcaaatgacttcggcagatgcaaaaaattttcaaaattttttaaaaaaattctttcatatacatttcacgcattttattaaggatcgttttcagcttgtacgctaatacttgtctggaaatccccataatctctgccatctgcgtctgagtcttattttcaaagaaaatgccataaataatcatgcgttcctccgcattcagcttatcgatcactttgtgaatatcctgctgttccatttttgtcagtacactgtgctccacatcacagttcaaatccgggaaatcctcaatcatgaatccttctccatcaatagactgtccactgtaaggtacctcccgcagcatcttatccacgacctctcctaattcgttcttaatctcaactttttttgccttgctacttctgtaaaaattgttcatcgcatacgcaacttcttttgtaatctcgatcatttctccatcaatatttgcgtagtactttccttcataaaaatatgggtgttcaatgtacatatccgttcctcctaaatttgaaatcttgttgctcgtttcaaatccagaaggcggacctctgtttagaatcatgcctgctccgcctttatcctgccgggatacgcccgcagttattggctgagaaattcaggcacgaaaaaaagccccagtagttttttcttaactactgaggctttcgtctctttcttgtattcagttatctatgccttctttcatcagcataatcattgtatcaggataaagttcacaaagtatccgcaatatgttcccataagttcatatcattattggaatcgtacatatttcagtataaaaagttcaccgtgttattcttctacttcttttccatctatatatagttgaaatttatcaggattattgactacatcatagtcctttccatattctacaggtctgtattcggctgtcattaccgattccccatcttcaatatcctctttccataaatagatgttcatatcaagactcgtcgcatatcccctgtctgtggagaattttgtcgaataaaaagaatcatccttgtacatctgcaaaagctctcttacaaacgcttctctatcctcaatatttttccggttagcaaccacggttaaattttcatcccgatttacggaaaatgttccaactacatccggttcgccttccttatgaccagattcagatttcccataaatacttcctgcagcaattatcaagatcactgctcctgaaatcaatgcaattatctttttcttcatatttttattttccttttagtttttttactgcgtaattgattacttcttccggtgtaggtctttctcctttaagtgtcattttcttccattcttcctgcacagccggatcaggattatcaaatcctgcatctatggctatctgcatttctctgcgtacttcttctggtgttgtgttgtacttttctgcaatcttctcataaatagttttttctctcattcattttcctccgatatataactggatttacaacttgttctatagaaccaatttagcatatttctattatcatgaaaagacactttacaacttaaatctgaataaatggtcaaaaaaagaagagctacttgctcttcccagtttgtcatatcactcttccaataatgtgtgaattactttgatgatttttttctgttctttgattggaagtttttcaattttttctgtcagttcatttgtaacacctgtaactgaatgtgccacaacatcaattaaaagagtatctgcagaaacatctaacgcatttgcaattgcaacaaaggtatccaattttgtaactttcaagcctctctctattacactcacatgcgtcgggcttaaatttactaatgcagccagttcctcttgtgtgagattttttgcttctcgtgccgatttgattcgctgtcctactgctttcaaatccatcgtaacacctcctccggaacgaataatcgttctggatttagtatacttgtggatgtcttcaatatacagaatcgcaaaaccaagttctaattctatagaactatatttcaagattttctttgcattttcgtaaaaaagcgttatgattgaatcagttaaatcaaaggaggtatcaaatcatgaaatcacataaatactggtccttaggcgcacttttctgtatgttgggatgcatttattctggaatcaaaaaatctatgactgcacataaatactttgcctattcttcattgctttgtattggcatgtccatttattccggtcacaaactggtttctccaaagaagaaaaaaatcactgaatcaaataatagtgagaatagttaaatgaaaatttgacctttattcatcaaagacaaagttgctggagaatattttttctctccagcaactttctttatctttaagccattgaaatacaatactgtccaatcagcttcgtccaactattatatttattcttttcacacacctttcggcaaatttcattttccatcaatacacagaacatcttatcataatcaaatgcccaaacagcaccattcacatggttttccactgctttctgatctatgctctttaagcgtgtgaccattttttcaatttctccatttcccaagttaccgatatttttgcagataaaccgaaagaaattcaacgttgcatattcgtcatgccaatggaactcttctggattgtttttaattttactggctcgttgctgttctttgattatctgatcagctacacctttcatcgaatcttcgtatctcatattattcacctactcttcctctacgcccagtgacggtttaaatcttttatcctttgcctgcggtaccacgatctcataaaaataaaatcctaaatacccaagtgcctgcttcttcattttataaaatgaagtcctgcctattcctaactcctgttgtacttccacatctgtcttattataatgactgcaaaaacaggaatgaaggatctcactgagcatcacaccattcggtgcatagaacttaaccagtgtcattccacgatagatcatatctgacaagccataaatgatcatcaggttattcatttcccggtgcatctttggcacattcagctgattgttataaatgctcagataactcaacgcatatgccatatcttcattgattttctcctggcactccatatccagttcttctaacacaatctgattttccaaaatcaatttctgatagcttgtcatcaattctttaatatcagtataatgtctttcaatcgttacttccaaataatcctgtgcatggcttgccatctggaaggtaatctctttcattgatttaattgcataatctctgtctgtcatcagtttcaaaatctccttatcatcatcacactaactggcggtctttcagaccagttcgctttccccatgattttgatgggaagcaattacttactacaacttgcagaagcggatatccaaaaggcattgtgggagctgcctttgctgaccggaatccatcttcttatgtaaaacctgcaggaataaaaagggaaagtgactatccctgccggttaataatccaaataatatcgtctataccaagctctccttatgctgtttttctctccataaaccatttatccacttcgtaaaacaagtggctttcctgcccttgtatcatacaggtgtacatcattcctacaccgcctgcctttctgctggcgcatcgctcgattttcaaaattctgtcaatgctatactttcttccatcctcccatgtaaaaaatatgggaaccagctgtccgtttttccgaaactctgctactacatctacatatactttgttcatgccgacacctcactataaaatctcaattgctcttggcgatgccgggattctgcggatatatccatttaactccaactgcttgattctggaaaatgctgatgatgttgatttcaccccgatcaattttccaaattcccgtattgtcggtggatatccatgttcattggtatatcgtaaaatacactgataactttcttcctgttttctggttaatgcttttttcaaatctatccctccaattacccatggaaataactatgtggatggatcgtgtgcgtaccagcgtctaagtgggataagactttatcctgatacattgccgctcgctgtatactgaaataaccaaaccgtcgtctgatctcatctacagtacgatccagcttctctaacttttcctttttctcctgatttccaaataaatccaactgcacgggaatatcatctaacacaagatccgcagctcggattcccaggcttctaatgggatgttcccatttgtaattatctttaaatagctgaaatgctgcagttacaatctcgtttgtaatattcgttggctgtcgtaaatgtatctgtctggaaaaactatacaatcgattatctcgaactgtaatttctactgttttgcatttaaatccatgtttccgcaatcgtgcagctacactttctgccaatgctatttgaatgatccagacatccagatcattttccagatctctcggtgttgtagtgctattacctatcgactttactggtgcttcatatccttccttgcaaaccggatcttcatcccagccatttgcgaaagcccataatacatttcctatttttccaaaatgactctctaacaacttttcgtctgattccgcaagttgcccgattgtccggattccaagtttttgcaatttcttatttgtctgtcttccgacataaagcaaatctgacgctggaagctgccatatcctgtctttataattttctcgattaaactctgtgattgcatccggctttttataatctgaaccaagtttcgcataaatcttattccaggaaattccaatacttaccgttacacccagttcgtatttaatccgatggctgatttctcttgcaatcgtcattccgcttcctttcagatttctgctgtccgatacatccagccaggcttcatcaattccatatggctcaatcttgtccgtatactccgaatagatttctcttgccatctttgaaaatctcaaatacaaatccatccgtggtggtacaaatatgatttccggacaaatctgttttgcctgccataatgccattccggtctttacacctttttgctttgcaatataatttgctgtcagcacaatcccatgtctggcttccggatcgccaccgactgccagcggcattccggcaaattccggatgatgcagcatttctacactggcataaaaacagttcatatcactatgcaggatcacacgctcactcaaacttttcacctcccagctgtttccttcaacatgatgtcttatcaatttttgtatgtttagtatatatcgacattccggagatagtcaagtaacatcttggttgtattttctccattttggagattattgttgattttatttctaacatacggtataatgcatatagaaaattcaaatagaaatgaggcgaacaaatgcgtgatttcggggaaatattagcagaaaatagaaaaaagaaaggatactctcaatcagatctggtagacctgctttctcaggaaggtattcaggtcactacaaaagcaatctccaaatgggagaccaatgcacgagaaccagctttacatgttttcctgacactttgccagttacttgatatcgaagatatatatgaatccttctttggagaaaacccatataacattatgagtggattgaatgaagaaggcagaaataaattgattgaatttgctgatattttgaaagcttctaaaaagttttctccactgtctgcaaaaattatcccattccatcatcctgtagaaattacctgggaaccagtttctgctggtactggaaattacctggaggattctgtaaaagaaacctatgatgtaggacaccttgctcctgagcagactgactttggtgtacggatttccggtgacagtatggagccactttatcatacagacgatgttgcatggattcagaaaaaagattctcttgctaatggtgaaattggaatcttctatctcaacggcaatacttacatcaaggaattacacgatgagccagatggtgtttatctgatttctttaaatcaaaaatatcgtcctatccaggttttggaatctgactcttttaagatttttggaaaagtaatcgggaaatgcaaaggtgcagaaattccgggatttcattagacttcaacagcaggttcatgatcctgctgataacaataagcaaaggaagtgattgaatggcaatcaataatacactaaaagatattcgtgaagaacggaatctcattcaagcagatttggctgaagccataggttcctgcagccagactataggccgcatcgaacgtggagaacgtaatccctctcttgagattgcaatccggctggcacattacctgaaagtgcctgtagaagatatttttcaggttgaagactgaaacacagctgccagaaaaccgaggagtaaaatccccggttttccttttgctcaaaaatcagtgtaatccttttacgaaatccgctgcgtttttcatatcttcttcattcggatggtctttagcaatacctccaaccagtttaaatggtccgaatgtgtcataccctttacaaccaaattttccaaccacactggcatgtcttttatccaaaatctgctctatggttttataattcgcactcccgccataagtacagatcagaaatatctttttgtcgtccggtagattcttctctgcaaattccaatatcgactgatgaaactttgaaaaatagattcctgatgcaaacccaatcatatcataactgctcaggtctgcatctggctgtttcacagcatcaatcaaatccacctgacattcttctgcgatcctctttactaatttttctgtatttccatgatgcacagatgcgtatactatcgctgttctcatttttcttcctttccgtctgctccgtcaatcaggtcatagctcatatccaaaaagtccaatatcttcgcttcactgactgaaccatccagtaaaatcgtgatccagtgctgtttatccatatggtatcctggtaaaaatccataagtctgaataatcatgctggtcatttctggattgcactttacatccataatgtcaaccagatcatttccctctaatcccagtttcgatttttcaaccgtcatgatcactgcataccattttccatttttatgtcgaagtactgcactgtccgatagtttactccataaatattccggcattgtgccatactgtttctgcacatattcaaaaatttcttctttcttcacaatctattcaactcctgatttttctgatatcctgcccataatcataccacattttcgtatcccatactacctgccaaattcttttgcatttttccggttctcctgactttaactaatagaggggtaaaacagcaaggacaggaagtgaggatacacttccggaaaatcccaatttagggtaccctgccctaaattgaaaaaacgctgaaagcaacgatactactgccctctcagaaaggagaacccaccaatggctgaaagaaagagaaacaaagaaattcatttttatgtcaccgaagaagaaaggaagctaatccgcaggaagatgatagaatcaaaaaccaaaaacatgggagcttatctgcgaaaaatggcaatcgacggttatatcgtcaacaccgataccactccactgaagaaacagtatgaggaaatgcacaagattggtgtaaatataaaccagattgcaaaaaaggtaaatatcaccggagatctatatccggaagaaatgcaagaattgaaagagatggtgaaagaattatggcgtatcttaagatcttccccgttaaagtaacagacaagaaagctctggactacatcacgaatccagataaaacagatgaaaaactgttagtttccagttttggctgttccccggaaactgcagatcttgaattttctatgacaagagaaatggcaaaaaagaatggaatggacaaaggtgataacctggcatttcatctgatccagtccttcaagcctggagaagttgatgccgaaaccgctcatcgcttagggcaacaatttgcagacgaagtactgaaaggaaaatatgaatacgtgatcagtactcatgttgacaaaaatcatattcacaatcacatcctcttcaacgctgcaagctttgttgatcatcacaagtatgtttccaataaacggagctaccacaaactttgtagaatcagcaatcgtatctgtcatgaaaatggacttgccaccagtatgccaaccggagaaaaaggtaaaaactataaagagaacatggaatatcatcgtggcaccagttggaaagccaagctacgtgttgcggttgataaggcaatctgggtttccatcaactatgaggaatttctgcaaaagatgcagttagccggatatgaaatccgccaaggaaagcacctgtccttccgtgcaccagagcagaaaaacttcacttatatgaaatctctcggaagctattattccgaagaaaatgttcgcatccgcctggcaaaaaatcgtagcaaagtaaaagctccaaagcatctgtccagagaagcccgcctgtatatcaatatctccacgtatgttacaaccggcaatcgagaaggatttgaacgatgggcaaagctcaataatttgaaagaggcggcccgcaccttcaactatctttccgaaaataacttgctgaattatgacgatttcaggcagcatgtatctgacattgaagcttctgtgaaagttgccgaccaaagaatagcacaaatcaacagtgaactgagcacgcagaaagtcattcagaaacactgtgattcttatcggctttgccgtaaagtaattgaagattgtaaatctgctaaaaatccaaaagcataccgcaccaaacatcaggcagaataccagctccacgattcactaaaaaaagagcttcaggatctcggcgttaccaaaatcccaagccctaataaagtccaaaagctgattgaaaatcttgaatctgaacaggctgctactgtccgggaaaaacaggaattgcagaaaaagcagaaaaccttggaaatcattcagcaaaatttctctgtgctgctcgatgctccggaaatcaattcagacttacttccggcaaaacgggaatccgtttctgtcacaagaggtcaataagattgcactgcaactcactcattttcttcccaaggtttcagacccatttcctcccaggtgacaccatacggtgcacctccggaggtataaccggcaataaagaaaaatctgtcatcttgcaagatttcttctttagccagattatctcttgtttcttttttctgtcttgctcgcctctgctgcttcttttgtttcgcaaaagctgcttttccctgatatgctttcgtgtactccatacagtagaacgcagcctgccggtctgcggcaagctgcgctcccgcagcgatgtttccatcgaccagtcctccccgcattaggttcagcaccgcacggagcacgacgggaaagagtgttgctttttcccccttatcgccttgttgtagcaggaacagtcctcttccttcgttgaataccgcacgcctccatctatcgccctgtcaaaaggtgccggcagatccatcccaatctgccagctgtcaaataatctggtatttgccatacgtttctgtttcctccaatcttttatttcctacaatcccttgtaattctttcggccgcttctttgaaaaatctctcttccaggttccttaccgtacaatacaattcgggtaaaaggtatttgggttctccacttttccacattccaatccattatataaatatattcgatcaaaggttgttcttgtcttccctccttttgccagcctgaacataaaaaaagacaccaaaaaacaattctttgctttttgatgtcttttctgtcttttcaggctgatgcccgaatcaatattacagaagtccgaacagacttctcctgtacttttcgcacaatctactttcaaatcccggacctctccagaatgaaatttcttattcaggatatttcccaaataaaactatttacgcaattatcatagcactgtattttgtttgcgtcaacatttcaatcacaatatatagataatatctgttgattagatgcaaatttctgtgctaaataattcattcaagttatgctgtatcattgctctgtttttcaaccgaagctttcaatttctgaaaagtctcttcgctgattgcatgttctatccgacaggcatccctttctgcggtttcccgatcaaccccgacagctacaagctgctccgtaaagaactgatgccgttcataaattttctcagcaacctcccgcccgtcttcggtcagatggagatatccatcttcatccacggtcagaaaaccgccattctttaacacacctactgcatggctgatactcggtttactgaatcccatgtgtcgggcaaggtcaacggagcgaaccatgcctttttccttttgcaatacaaggactgcttccaaataatcctcgcccgacgcataaatcttcattgccgcctcctttactgtgccagtttccagccgatagcttcctgcctttcggatacgaagtccgcatacagacccttctgctggatcagttctgcatgagtgccgcgctgaacgatatgggaatcatccaataccaatatctgatccgcaccccggacggttttcagacggtgggcgatcataataatagtcttgtcgtgcgtcaattccgcaatcgcccgctgcaattcttcttcattttccgggtcaacgctgcttgtggcttcatccagaatgataatcggggcgtctttcaatatggcgcgggcaatggaaatacgctgcttctcaccaccggacagggttcctccgccttccccgatcaccgtatcatacccgtcggtcagggcggaaataaattcatggcagcaagcctttttcgccgcctctaccacctgttcgtgcgtggcatccgggcagccgaatttgatgttgttctcaatcgaatcggcaaacagatacacgttctgaaataccatgccgatattcttcatcaggctgtccagtttaaaatcccggacatctttgccgccaaccgtaattctcccggcgtctacatcccaaaatcgggcaatcaggttgcacatagtcgtcttgccagaaccggacgggccgacaatggcagtggtcgttccggcagggatcgtaaagctgacatgatccagaatttttcggtctgcataggaaaagtccacattatcaaatataatttccgaggatgccggaaccacatctgcgcccttttcatccatgaccggcgtatcgtcaatagagtttgccgtatccatagaagccgccagcatttgcagcagggaggccatgtttccggcgttttccagatcattgaacaccataaaggaagcgatcaccaaaatcacgccataggccaatgacagggaaccgttcagccagaagtaaatggaggccaggagcagcaaaacactgaacacccggacaacaacctgtttcagggcatcataggggacactggcttttgtcagtttcaaattgtcccggcagcttgccttgattgcgctgtcaatggactgtgtgctgtccttctccataccgaaggctttcacgatccccatcccctggatatactccaggacggattccacaaggctttcctgtgtatgctgccgcactccgcttaagcgctcagatttgcggagcgccagttccgccgctgcaagataaagcaggacgccgactgcggcaatcagaccgatccgccagtcaaaaaccaccaaaacgatgacaagcgccaccgaattgaaaaatccgcccaacacagataccagcacacgcgccgccgaattttccacatcccctaacgtggtggtaacgatagcggtaatgttcccgatactgttcttgttaaaatatcccatcgggatgtaacgcagccggtctccgatgtggatacgcttttccgccaccatacagtagccggtttccgtctgctccatcgtggagaaataggtcgtgatgatccttccaaccagggaaacagccatgatgcccaaagaaatccagataaaccggctgtcccggttatcggataccaacgcctccaccacgataaagagggcggcaaactgtaaagccgcaaacaggccggagaggaacgcaaacagcagggattttttcagcagtccctctttgctgccagcaaacgcaaaaatttttttcaatgttccatacatttgacaacacccccttacatatgatcctttgcgccgatatgcgcctgccacatatcccggtaaaggggacaggtttccagtaacttatcatgcgttccccgggcatggatagttccatccttgaccaccacaatattgtccgcaccgataatggtagacaggcgatgggcaatcacgatcagcgttttacccactgtcagggcagagattgctttctgcacaactgcctcattctctggatcgatatatgctgtcgcctcgtccaaaatgaccacaggggcgtccttcagcatggcgcgggcaatggcgattctctgtcgctcaccgccggaaagatgggaaccggcgctgccgacaacggtatcatacccttgatccaacttgcggataaaggtgttacagccactttgttttgctgcctgctccacctccgcatctgtggcgtccggcctgcccatgcggatattttcccggatgctgcggttaaacaggtaattatcctgcgatacataggaaatctgggcgacaatttcagacagcggtatctccttcagttcatggccgcccagggtaatactaccggacgtaacatcccaatacccagcgatcagcttcgccacggtagattttccggaaccggacggtcctacaagggcggtcatggttcccggctgaatggaaaggctcacatcatgcagcacctcagtttccccatcataggaaaaggaaacatggtcgagtccgatactggtatctgccagatttactggcgtatctttatggttcagttcttccgcgttcaatagctggctgatttcctccacattggttcccagtacagccaggtcatccgtaaaggtaaagacggacatgatcggtcccacaagccccagggagaaaatcacaatggagaggaacgcagataattccaggctgtcggacagccagaaggcaaacccacagggcagcacacagatcagcactgagggaaggatcgcattgtaggcactcatggttttctggttttcccgcatccattccacatagtaattcgcattgtaattcacggcgtccgaatatttcttgtaggaaccggctgactggctgaacgccttgacgacttcaatcccgccgatatattccacaatggcattcgccatatcttttccggctttgaccgcaccctcccatttctttgggtaactcatcataccgacagacattacggcaagaccgactaccagcgtaacaagggacaacagcgccatgcgccagtccataatgaaaagatacacgacaattaccaccggaaccaggatgtttgcggtcatctccgggatgagatgtgcaaacgtggattccatcccttctacccggtcaacaatcgttgttttatactgaccggacggagtatccaggatcgttcccatcggaacgcgggccagtttccctgtcagcctctcccggatatcccgcagcgtgtaataggccgctgtatgggaaatagtcgttgacagactggaaaacagcactttccccaggtagccgcaaagtgcgaccatgcaagctgtcacataacgggaaaaatcctgctccccgtccaacatcattgtgacgatatgcgccacacagaaataaggcaccatctgacaagcaacacccaaaaccgcaaggacgacactgccgatgaattttccgtgatacggtttgccccatcccaataaaacacttattggcgacgctttcttttcttccttcatttttcagataccccctttatgaagtattctcttatttttctgaggccatcttcatccattccgtactggtcaataatcgaaccatcctcaaaatgaatgatgtccgtacagcaatctaaaatcagttccaggtcatgggtaatgacatacacagtgattccggcatccctgacctgccgtaatacatttgcaacctctttcatatgcctgtaatcaaggccgctggtcggttcatcaaaaaacaggatcgagcgttttgaagcgattaccgaagcaatcgcaaccctttgtttctggccaccggacagggacatgggatgcctgtccttaaaatccagtaaatctaaccgacttaggatttcttctgcccgcttctggtttgcttcctccatactgatcagcacttcatcaaggaccgactcggtgaaaagctgatgatttacctcctgcatgaccatatagcaggtattcagccggtctttcggacggtatttctttccgttccagacaatctccccacagcgcttctccaagccacagaaacagcgtgaaaaagtggatttcccggcgccgttattcccgataattccaacgatccggttcgtagggatttcacaatccatgatatgtaaggtttccggttcgtttttataggcaaagtggaaattacgaagcgcaagggcggtcttttcctgctgcggtaaaaccggaggcaggagacgctccaaagcaaacgtgcgcagtcccatatcggaacgctgctgctccgtgagctgctcaaattctgccgcagaataatcatgactcacctgcccgtctgccagatagataaaccgatccgctagaccgcgaagataataaagtcgatgttccgatacaatgattgttttcccctgcgatttccaaaacgcaagaatctttctcaaatcaaggatggaagccgcatccaggttagatgagggttcgtccataacgagaacatccggttccataatggataccccggcacaggcaatcttttgtttctccccgccagataagtggaagatattacgatccatcagcttctccagccggaagtcccgaaccgtttttgccaaccgttcccggatgtctttttctggctgtccaagattttcgcagccaaatgtaatttcactggtggtatccacattgaaaaactgggaccggggattttgaaacacgctgcccacaactgcagctgtatcgtaaaggggctgttcggaaaccttggctccatttacccatacttctcccgtcatctttccctcataataatgtgggatcagtccattaatcaggcgggtgaccgtagtttttccacacccactttcaccgcaaaggacaacaaactgaccatcctctatatttagatcaatatcccgaacaccgccggtattttcattctcttctccataagaaaatgaaatatggtcaatctttatcataagctcacccccttaaaaagaaaaatactgtcccagcaaaaacagagcgaaacatatagcacagagcaggatcgcaatcatgtcctgaacatgaaaaccaatctgacatacgttagtccgtttgaccggagcgccaagcccccgcgtcagtgcagcggcggaaagttcatctccaattttcacaacagacaccatcagcggtacaagacggtattccaccatcaaaaatggatttttccctccaaaccggatacccctcattttcattgcatcactgattgcctggtattcttcgctgatcgtagggaaaaagcgaaaaataacagacaaagggatgacgattttctctgtcaggtgcatacgttccatcgaaccgataaactcactgactgaggtggaggaaagcagccaggcccccgtcataataccaggggcaaaccgcgtcataatggatgtcatcgccaaaaccacaaaggacagcagatcgcttaatgtcgtcagcgctatgcgttccagtgcaaagcaggcgagatataaaagcaggtacttgcctgccgttttgaaacggcgttccgacaggatcagcacaaatgggattaggcttaacacaggttttacaaaattcataatcccttcgttgctggtgctgaacatcaatgtagtaaccgtcaacagcaaaatcaacttcgtacgcgggtcgagccggattcctttccttttgtccgttgtggcggaaaaggataccccctccattatgcgatgcccgctttcgcaaaatgttttttcagaagcgtttttccaagcagtccgcccaaaatggcaaagacaaaaatcccggcaaccacaaggataatgctccacatcggcataaccgccattacccgatcggcatatttttccccgaagctggcggcaaagcttgcccaggagtcctcgaccataaaatacatcggaatatatgtacctaccatccacaggctaaatacagcataaccaaggatgcttttctttgcgcttttatagtcgccggatttcaaaatgagatccccaagcaggccgaaaatcagtcccataggaacaccccaaaaccccatgccggtaagtcccatcagcagaccgctcaaaacacccatgattgtaaccatgccaaatttcttaacccttgtgaggaacagcataaaagggataccggtaatcagcgaccacaggcttccgagaacaggaagaaagatcgggacaaacccaatcggaatggcgacacagcagccaatgacaaagtaaagaaccgtgaacagaccaaggttaatgaggtcttttgcttgtaacttgttattcatgatgaatacctccacattcattttccagttagcatcttctaacctttttttatagaatagcatagtaccggctgattctctacaaccaatcatctttttagctccaaacagcaccgagtttttctgttgactgactttgactgtgatcttataatagaagtgcaaggctcaaacagagcggttaacagaccaaatgacaggagttagaaaatgaagatagatgaaattatcaagaaaagcattgaaattccaggtatatctataaaacgaggcgaatttagcgcagaactcattctaaaggagagagacgggaaaggttccatgacttttttccctctgttcccaggagttacattggcttatatttttgtgaactctcctgcctggacagccccagactttcacgataatggctccatggaaacaggaccattactcttaaattactgtgtaacagggcgatgcgaactcatcctgaataacgggaactttgtgtatgtgaaagatggggagatatccttaaccgaacgattcgccagacagcaatacgtttatccccgccgaatctatgaaggaattgagttttttgtggatatggataccgtaaatgctcaaagctcctgggtagaggctgaatttgatattgatttccacagactcagagatctttactgcccggatgggggtacttatattgcgtcggttacgactgagatagaagaagtcttaaaaaagctgtggtcattactggatatttctgttccgctggcaatcccacaaatgaaaatctatacccttgccctgttttcactgcttcaaaatctgaaagaaataccaccttcccaatcctgcacattcttcacagaaacacaggtagacattgcaaaacgtgtggaaaaaatcatcacttctgatctgcgccaacaccatcctgcgtgggaactggctgcacagttttccgtcagtgaaaccagcctgaagaactactttcgcggagtttatggtcaaaatatatcaatttatttacgtgaaattcgtatgcaacgagctgctgaattactcactactacaaacttatctgtatcggaaattgcagaacaagttggttatttgaatcaaagcaagttttcttcggcatttaagaagcagttcaacgcttcgccattagaatttaagcgccgcaaaaatttagagagaaatacttccaactgacgggttctaacatttttcacaataaatatttttattagaaactcatgacaaatgaagtcagagtcatttcttatattataggaagtgactctgattattataatttataaaagtacctataaattttgcataagctttaatcaattattccttcttcaatagtttcttctttccattgctctttattcttaatatacgcataatatttatatataagttcatatgtcatgggtttaatttctagattcattttttttaattcagagcgtaagttttctgttgaaaattctatctgtctttcttgtttccaatatttatcatcaaaaaaatcaagaaataacgttataggcaaatcatctctattattcgcaatttctatccattcgtttttttctaaaggttgcaagcaaatccctatcctatctacaatatctacagcatcttgaaagctaatctctttcgtatttataacatgatatgtcttgccatattgatcttctatttgggatattcctaccacgattttcgcgacatcatctatcgcaatcggcgctatgcttcctttaatatcaggatatactcctagaattaaacaactttttattattctaaaaataaagtctccatcattacatactcctgtttccgaatccccaacaacatgccccaatctgtaaaccattacagggattccacattcttttgctttccatatcagtccctctgcaacccatttactttgtgtataaccaataggtaaaatacccggatcagaaatatcatcattttccataattatattatcgtttgttctaaattttgaaaaaattgatattgtggaaatataaaatattgcttttattttcttatatcctgcaaaccgtattatttcttttgttccatttacatttatattctttaattcatagtaatcgctcaaaaaatgtacctttgctccattatgataaatacaatcaactttttcagctaatttctcataaacatccatgtccattcccagattaggttctcccaaatcgcctaaaacgatatgaactcttgcttcttcataaagtgacatattaattttatttaatactccttctaatctgtcctgtgcagcttccattgatttcgcccttatcaagcaatatatttccatattagtttgccttaatatttctttcaacagatagtttcctaaatttcctgttgctcccgtcaatagacatacttctttttttattggcacactctttccttttaaatctatatccaattttacttccatctctaattcttttgatgtcaaccctgcttttaagcaaccatttaaaatttcatatatggcattacttagtttttctactgtaggataagaaaaaatatatgaaaatggtatatctatggaattatcaaataatttttttatttccccaactatccgaattgcatttaaactatttcctcctatcagaaaataattttcatttattttcaaatcctttcccagttcttcgctccatattttttttatttcatcttgtaattcatatacagtatacttgttttttctcatatggcttttattgtttctcctactattatcattatatgttctacataaataatccttaatttaaagccccttaatacaaattggcggaaatttatcgggataaatatcatgtgtaggtcctatacatgtgccaatatcattccataacttacataaattcaattggtattgtataaactgtcgatcacatttttctttaattatagtaataaattcatcaaaggcattggctattccctccggccatatattctcatatatgtcttgatatgtgtattgaaggcattcttcgtttaacacttcacttactttttgttttgaatactcattgtctccaaacagctctagtatattatctttcttagggataaaatatcgcggttcccacagtacagctcctatggaattatccataactaattgaccgctttttgtaaaaactacgattctatgaaataataatgcataattgtctgagtcttgcgaaaccattctattttcaactttcaatatcaacggaatttcgtttatgctcccttccagtattgttaatattccatttttttctcctgtcttatatactttacatggtgtaatccctcccaacattttccctataatgtccaaaagaggatacaatacttgtatactacattctgcttctactaaaatcggatccgctaaatgaagaattttatttgcatatctaatagctgccataccagacggtagctttgaataaaaattattaatataataatggcatttattcgctattgctattgcatacaattccttcgcatctgtaaaatgaactggttgctcttgaatcacgtttattcctttttttaaacactctttagcaatttccgttccttttccaccagtaatagatgattttacagccacacatacaatatctacttcactgctacttatttgtgaaacatttgtatataatggaacgccattactttctgcacactttctagattgttgactcccttttgataatatcccaaccaacttacattttgtagtttttcttgtgataccttctatatatattcttccaaagtttgtcccacaaactataacccgataaaatttattttccatatttaatttcatcctatctactttgtttaatataattcataatcttaatcaaagagaataaagtaaacatctatagttgtatttactttattctcttttttgtttattttattaacttggccacttcacgcacatatggttctttaagacagctaatatgttcccctggaatataatctacagttaattgtcctaacacaatgttttcccacaaacttttattggtaatatttctaacagggaaaaaatgcttcgtatcatcttccacaaacattgcttgtacatctcctacatataccgaaggttcatagtgcatgattcctttgaaactgtgtcgaaacagaagaaacaacattttaaacatacttacattatccgcatcaattttctcatcaccagaaacattctcatatattttttttagcctttcttcttgtgataatttatttaattttctaaaactcatgcccaaaatttcatattctccatgtaatgcacatagatctcctatcgatatacctttatccccattttcctctttgtatgtctctagtgctttttgtagcaaatcattactccccaaatatccggctttttctatatccgctcctatagacagtccaaatgccctttcaagaagcagttcattatcataattatgaccgcacagacttgagctgattgtaattactctgcttacatttttccctttctcaaccagaattcttgccgtttccaaagccaaccatccgccaacacaataaccaattaaaatatactcttctgctggatgctcttctaaaatgtctgcatatactttcgcagtttcgatgatcaaactatccgtatctctctccaaatatttatcaaaactcccaaaattgaagccacatagcagatcacaaggagcactgatatttgctaaatatggaagaagttctttataggaacttaatgttcctgttccagcatgaaaaagtactcttgcctttttacaatctccctccgcatctttgaacgtaataaatggagaaatttctgggacattctcctttttttcactttttgtcacaaaattattttgtaatttttcggcaattcctcttatagttgcatttttcatcatctccatcattaaagcatcccatttccagttttttgcttccggtaagttttgaatcattttactaatcgcttgtgcaatgagtaatgaatcaccacctatcgaatagaaatcatcatttcgtcctatgttctgacaaccgataacttcacaccatattctctcaattcgcttttccaagtcatcaatgcattcttcttttttctctgtttgattagaattgtttttttgtaaatacaattttttcctatcaattttgccattattagtcattggcaactctcttaactgaactattctattcggaatcatatatgtaggaattttcccttttaaatattcttttatttctcttatatttaattcactttccgacgaaaattgaattcccatcaatacttgtccagcaggatataaaatgtcgtttttttcaggatatgacataaaaatattaccctccatagttttgataatgcgttgccactcatcaaaatttataaatatactttcacttattttacgcccatcctcatatttaacagccgcttctgcgaactcaaactccacagatgtcatcagtgcatatctttttcttacttcttctataataaataaactaccttcattatgaagcatttcttttagattattgagactttttttaatatcaacagcattatgcaaaacatttccacataatataatatcaaatttctcattttcaaatccttgttcccaattcgatttattaatatcatagattttgtatcgaatccaatcattatattgtgaaaaaatcacttttgccttattgaaaaagaaattagatatatctgtaaaataatattctacattacatgactgtattttacttaataattctatgctactacctccaactccagctccaacctccaaaattcttattttctttttcttttgctgttttataatctctaatacttcgttgtgaagtattctgttaatagatctattaacaatattatctttatatgcagcatatgctatatcaaaatttccttgagggaacaacaactcattcggatgcattactcctgtaattaactctttgagatgcatggaggactcatgtatatactccatcaatacgtcactatattgaatcttcttatctactaatttccactcttcctctgctttttctgcaatattagtactatatatctcttcaatataaaatccttctttatccaaatgaagatatttgttttcttttaaagccatcaaccatcgcataagtagctgctcatatttcggtattacatttaaaatacctttaatttgttcgaaggagtatcgcttttcaacatcctcaaatactttttcatttaccaaaaagcgtaagatatacatcaaggctgttttatctgctttttcaatccattcttgaaattcctttcttgtaaattgaaatttaaattctttctcctcatcaattatttttttctctattacctttttttcttgcttgcctttatttcctagaatgtaagcagttaaactaccctcattactttttacaactactgcattttctattcccgggtatctctttaatgcattttctatttcgcctaactccactctgtatccattaatttttacttgtgtatcttttcttcctacaaattcaattaccccatcttccctatataaacccaaatcacccgttttatatactctttcctcaatttcagtaataaattgaaatttttgatctgagagagttacatcattcatatatcctttcgcaagactctttccagctatacaaatctctcctataacataatcaaggcaaggcaaattcttttcattcaaaatataaaatctttgattagataaaggaattccataaggtatatttttatccgtactttttactctatccgttggataatatatggaccaaatgcccccttccgtagctccgcccaaactaatacattgaacatttggcattttttgatgaattttttcaactaatttaactggaatccaatcccctgatagcaaaattaagcgcaatgtatccagcttgtactcggtagtctgtaaataagccatatacatttccatttgcgccggaaccaaattaagcactgttacaccatgttcctgacatagtttaaaccaaaaggaaactttttccttttctgtttctgatggtaaaatcaatgttgccccaacaaaaaatgtcgcaaaaatatcaaatacagataaatcaaagtataaatttgaaattccgaatattctatctttctctgaaatattaaatttcttgcacatatccataattgtattcatcgctgcggcatgactcatctctactccttttggaattcctgtacttccagatgtaaaaatacagtatgccgttgactgtggatcaatatacttatattttatatcccatacgttgttaagcatttccgcatttagcaatatacttttttcatctttccagcatgtttgttcatcacatatattcaattttatattagcttgaatcattatttgttgtatccgttcagctggttgcgtaatatcaattggcacatatactgctccaactgacattaccgcaaccactgacgcaacttgccatacacctttttcaagcaaaatgcctattttatcctcttcctctacatttttttctattaatcgctgttgaattgcacttacatattttagaagatcgctatatgaatatttctctttctgataaataagcgcagtattataaggtgtattcctacatctcgtaaaaaaaccatcaactaaagatttctcatcaaaaggggtattggtatcattaactcttgcccgtatttcttttgttctatcgcttatccctacttctaaatttttttcaaaaaaatcctcgtcgcttatgcttttattaattagctggatgaatgatgcaaacatttcatcaattaatccttttggaaataccccatctcttatatcccaattaatcaatattccatttatttgtttactgatttggcaatctataataacctgaggcgtttcacttattttatataataattgtctcttacttaatgtgctgtcttcactttcgccccctattgtacttgtaaaaacatacgggaaaagattttcttttccttttctttttagttcccgcaaaactgctattccagtaaagctatcatgtgctaaattttcaaataaattgctttgtaccttctctacttgtgcgtttacttttccctcaaacgttccatcgaattcaaataacgatgttgttgtaaaatcccctactattctctgaatatcctcatgaatacttggtcgttgtagggttgtaatattaactgtaaattgactatttcttgaccaattgtttaatgttgcacaatacaaatacaaaagcaatgctgtcggagtaaaatttaatttctcacatttactcaccaaatattgccactttttaggatcaactgtatattctttacatatgaaagttcctttccttataatctccggttcctctcttgtatacagctccggttttccaggaaaaacatcaaccttattcagccaatatttttcatcctcataatatttgattaaaaaatttatatcctctttctgattctgattatatattatataatctctgaaattcagtgttagcttttccattttttgattattgtacaatttctccaaatcactaataatcaaatctatactaacaaaatctccaattaacatatccaatgacaagcataaaatgctcgcattgtcatggatgaacagacataaatcaaacaaaatatccttctctggatcatattgtttaaattgcatttcttccctcttggcaagtattttatgttttattttttctttctcccagcctcttatatcgtaaatttggacaggtgcattaaatatgtatggtaaaaatctttgctcgccttctttcgaaaattgaactcttagcatttcatgtctttcaataagtttttttacagcatctcgaaaaataatctcatctgtaaattcagttaaaaactcagcataaactttacaacctattccaccataaagatacccctgatttcttccaagcagatatgctgtctgaatatctgtaagcggaaatggcttgtatttttgatcttcgctagattgaattttttttctctcttttctgtttaagtattctataattgcgtctttatttacttttatattttgttttagtttttcatcgaaaacgccgactggacttctaaaatgcaatttcccattttcaatccataattgtatttttcttttagcgcattcttcaataatactttttagttccatcttttcaccctgccttaataattttcaaacacaataaattttatctacccttccgatttccaaattattttgcaattatcttttataatattccttcattatagtcctccgtcttttctataattctctttgccaattttcttacactcgcattttcatacaaatcttttatcgttattacaatattatatttttcatttatcttccttattagtttcaatgcatttaatgaatctcctccaatagagaaaaattctttatcaacacttacgcgaatcctcaggatattttcatactcgtctaaaagtcccctttccaaaggagttgttatttctgttttttccttattattttcttcctcgtattgatactcttctgccaatttttttctatttatcttgccattatctgtaagtggaaactcatttatattaaaaatccgctttggtatctcatatttaggaattgtcgattctaattttttcttaattattttttcatcgtaataaagttttccttctactattccaattattacaattccattgttccttttaataggaattaccacagacctattttctgggaaaatatcggatacagcagcttcaatttcgcccaactctaccctgtacccattgattttcacctgattatccagtcttccaaggaattcaatattaccgtcattccagtaccgtcccatatccccggtacaatacagtcgttctccatttctatctaaaacaacaaatttttcctctgttttttctttatcgtttaaatatccctgtgcaacaccgtctccggcaatataaagcgtccctggtacccagtccggacaatcttccatattctgatccagaatataatacttctggtttgcaagtggttttccatacggaatactcttccaatcttccggcacaacctctggaatctcgaaatgattagaccagatactgccttctgttgctcctccaagagcaacaatctcaacattctggaacagattacgaattctccccggaagtgaaacaggaacccagtcgccactcatcattatcaaccgcagcgattgtgaagttacctgcctttgatattcctcatattctgccagcatttctacaaaagctggcacgctgttccatacggtaatattctcatgattcaaccagtgaatccaatgcgctggatcttttccatattccggatccggaagaaccaatttcccacctgcgcctaaaacgccaaaaacatcataaacagacaggtcaaaatgaagattggagattccaaacgccgtatcctgttctgtaatctgatagcgtgcattgatatccagtattgtattcactgcattatggtgagtaatcattactcctttcggcatcccggttgttcccgacgtatagattacatacgcaaggtctcccgccttattctcctgtgctttgtattcagaatcggtttttaatccagacacagaaatacaatcccactcgtgcagccattcggtatcctgatcatacgcctgattctgcacaagaatgattcttgttccactgtcacggagaatcttttcaactcgttctctcggattatggatatctatcggaagatatgcggctccggcaaacaggattccataaacagcaactacctgctcccaccctttttccataaatacagctaccgtctcttctttttttattcccatgctcttcaactgcccggaaatgtaaaacgcctcttcttttatctcccgataagtcatccgcctgctgcacgttaccagcgcctccttatccggaaatttgtctgccgcctccaagaataatccatccaacgttttctcttcaaattcagctgccgtttcattcgcctgacgccgtttttctgaaatttccgctgttaccagacttgccgttttttcctgcatgatctccggatgaactgctagcgtatgaagcaggccggtatatgcccggaacatctcatccagcattcccggataaaataattcgtccacggaatcccaaaacaggcataaacagccatccatttcaaccacctgatgatccagccacacctgcggcgtctgtgaaatgttatagttcagttttccaagccactttccttcattccactgctccacgccaaggccactggtaaacactaccggcataatagcgccccgcatatttccagtctttttctttaattcgcgctccagttcaaccgcgccataagctgtatgctccagatcttctgtaagctgcttctgaattgcctttgtcctttccgcaaaattattccctgcattctttatctccagcaatgtcagtgttgtaaaatctccaaccagattgttcacttccggatgcaattgtttccggtcaaactgcgtcagattaagtgtaaaatccttattactgctccacaagcggagagtctccgcataagcactcatcaaaagaacagaaggcgttacctccagtcttcccgccgcgtcttttacagactgccattctttctgtgacagttttgcgctccggcgacagaaacgctgctctgtaatctggctttcgttctttgcaagcggcagatccggtgcgtccgcaaaagtctccacccggtcttcccaatattttttatctttctcataagcagaggtagactttatctgctccagtcccagcacgtaatcccggaaagacaaagtaatcggcatttccgcttttccatttcgatatacttctgcccactcatttaagagatggaacatactccagccatcaaagataatattgtcaaaactgatatggattctatgcttctggtcctctattttagtgattcgcacatcaaacagaggccattcatctgtctgaattacctgatgagacatctctgcccgtttttcatccaatgccttttctttttctgtcacttccaattgtcggatatccgtcacgtcaatatgatactggggagtattctccagtatgcgctgcataccatccggctggataataacacgcatcatcccatgcctctgtatcaacagattccatgccgtctctgcgcactcagtatcaaggccgtctgcatccagttcaaaataacagtgcgttgcaacattccccaattcatacaatccgcttctgccaagccagtaagcatactgcacatcggttaatgggaacggatgatatgcttcctccagattcggtttgatctgcagtgtatcttcttctttctgttcggactgttcaatagcttttgccagagattttacggtcagattttcaaaaatcgtgctgatcgttattttgcagccgaaggttttctgtacttccgagatcaaccttgtggcaatcagcgagtctcccccaaggctaaaataattatcttcaattccgatattttcatatccaaataattgtttccagatatctaaaagcttttcttctgtttctgtcgttgcctttgaaaatcggataaccgcagtttcttctttaaaatcttcccgcaattgcttcctgttaatcttcccattggacaatgttgggagctgctccatgaaatgataattctgtggaagcatatactccggcagtttttctgacagatattcccttagtgctccattatgataggacaggacagacgcctgctgtctgctgcagcatatacatcttccatatctctctgtcacagcacagtcttcgcccaatcctgcctctgataaacattctctccacagcaggcaatccggggtaaccagccctgcttcttttctcttgtcccgaatatccgcaaaaccattttccaaaaaagccgctgtaagttcctgaaggtatgtccttaccacaaggtcagtcatcagcaatattccgtttggcttcagtaattccgctactttctttaccgcatccgcagcatcaatatttctatgtaaagcatttaccgatatcacaacgtcataactatgcaaggacatctgctgcttatccatgccttcttccagattcagcatctcaaactcgactctctcatatcccgcaagttctttctctgcttcctgcagaaaatattttgaagaatccgcataagtataagccacgcttacatcttccagtgcattcaaaaactgtcttgtaattgcagtgtcccttgtaccaatttctataatctggagtggctcttttctgcgttcttctgccagaagccttaatccctgcaccagtctttccactgtttcctcgcagcccggaatcctccgaagcagcatattcggagccaaagccggctctttctggtagaatacgtccagcggaacttcattcccagtaaccatatgcttcagatgcggcttcagtttattaaaatacgtttccgtatctccagctttttccggtacagccacttccttcccggtacgcgatagtctgccgtcctcttctctcaggattccttccttctttaaaatttccaaccatcttgccacagtattcttctgtgtttccgtaatgctccctttttcaaaaatttccttctgcgaaagaacttccttctctgatacaaaaatgcctaactctatgagtgtctccagcataagctgtacacatctctggtctgcataggcaaggaaatttttgtatgctgtcttccgttcctgctgcatctgccaattgctgacatcatccttcagttctttccagcccccgccaaagatatctgtgccgtacaaatacgttgtaactttagaatcttcctgtatcggcgctccgatataagcagccagcgttttattgccatgaccatcactaactgtatcaacaactgcatgagccacacccggaaactcctgaatcacatgttcaatttctcccaattcaatcctgtgtccgcgaatctttacctgatggtcttttcttcccaaaaattcaattgtctcatcatcccagattcttccgagatcgccggtccgataccatcttccatactgatctgtgataaatttctgccccgtaagcgcagaatctcccctatatccttttgctacaccaaaaccgccaatccagagttcgccttctgcccagtaagggcaatcccttccatactcatccacaacacgatatgcctgatatctgagtggctttccataaggaatagatttccagtttttcggcatcggcagggtaacattctgataattggaccagatacttgcctctgtagctcctcccatagcgacaaactggcaatcctctgtccatgccgcaaccctctgcgggagatccatcccaatccaatctccggaaagcataaccgccctgatcggcagtttctgtttcatggattccgcccgtatcaaaagcatatccagaagcaccggcactgaattccaaacggtaatctgatatttcaacacttgttccagccagtaatccgcattccttctctcctgctctggaagcaataccaatgttcctcctgcgcctaaaattccaaaaacatcatataccgacaggtcaaaatccatagctgatacagccagcgcccgatctgcacttgtcacatggtacttttcattaatatcctgaaccgtattccatgcgctttcatgcgcaatctctacacccttcggaacacctgtagagcctgacgtcatgatgatataggcgctgtccttcggcgacacctctggcagtctcacattttcctgtccctcttccataccttccatcacaaggatttccgtaccttccggccagtccagtttttcggataattcccgattcgtgaccacatagcggactcccgtcttctcatggattaacgctctccgatctttaggctggcttaagctgaccggaaggtatgaatttccggaaagcaaaattcctagtgccgcctcgatctgttctatcccgcgcggcagggtaagtgcaaccgggactcccttaatatccttttctgaaatccctgccgccactgctgtcgcccgtgcttttaattccccataggaaaccgatcttccgcttcccgcatcaataagcgcaatatcttccgggcaaacttccgcatggttcataacagcccaatgcaggcattccacacgctccggcactcctgtacgcgctgtatcttcaatttctctttttcttttttcaggaagcacatcaaatcgctgattccagtccttctttcccaattcatgcagaagattctcaaaacactccagcatatccgggatcatattctccgggaataacttatccacgctgtcccatgtaagctgtacgccattttcatcttcataactctggaagtcattccacacctgcggcgtttgggaaatcatataggaaaactgccccagttctttccggaacgtatcatttaccaacggcgttcccagattgcaggcaaaaacaaccggcgccactgccgatgcgtctccatacatctgtgcaagatctctctggacttgcacgccggaatatgccgtatacttcatatcctcatgaagctgcttctgaatcctgtccaacaattccgcaaaagtcggattttcttcgcagttaatctccagcaataacagagtagtaaaatctgctattacttcctctaacccctgctgctctgttttccggttaaaaaacggaatgttaataaggaaacaatgattcctgctccatcgttccagaaccaccgcatatacagtaagaagaaccattgccggagttgtctggtatttttttgcccgcatttgcaaatgatcccattcttccttttcgattctcacaatcctgcggttgaacaccgttttttccacttcttgcggacgttttgccaatggaaggtcagggccttttggcaaatgctctaaacgattcttccagtatttttctgcgtttttccgttcctcctcttcttcctgtttctgccgttccagataggaagcaaaattccacccttttgattctttcggcaggttttcccctcggtaagcagatgccaaatccctcaataatatctgcagactctgtacatcagcaaccagaagcgccatgtccacatgaaggcgtgccttattttcaggaaaaagcgtaagctctattcctgctacttcgccttcctcaatctttaacttccgatgggataaacgttctctgacagatactgccattgcctctgcttcctcagatgacatccgggaaaaatcatgaacctttattttttcacaatacggcttatccaggattttctgtgttccatcatccaaaaagcaggcgcgcagcataggatgatgatactgcagtacattccatgctttttccagacgctccggttctatgttttccccatcaaactccaaatatgcgtgacagtctatccctccaagatactgttcttcatccctgccaacccaatatgcatactgtacgtctgttaaaggaaacggctgtttcatatccttttccggcgttatcttagattcttgcgcccgttttttgcccgcttttttcttcatgctgctctggattaacgcccaccagccttcaaaggtgggattttccatcaatgaaccgaaagaaaccttaaccccctgttttctccactggtttaccagacgcatgatcgtcagggatgaaagcccaagctccaacagattttcggaatctccaaaatctctggctaccggcagtttttgtttgatctgttcctttatctctatatattccatgctactgtctccttctacttttcctgagccatccgttctaatgctttcttatctattttccctacgctggtcagcggccatgtttcaacccgttctacctgatctggcattttatacgccgcaacgcctatttcccgtagaaacctgtggatttcctgtaaatcgatcccggcttcatcatcggttacaaggaatgcgcatatccgatttccaagggtttcatccggaacgccgacaacggctgcctctttgatctccagatgcctgcaaaggtaagcttcaatctctgaaggcatgatcttttctccggcgcggttaatctgctctttgatcctcccacccaaacgcagtcttccgtctttcgtccacatagccttatcgcccgtccgataaaatccgtccggcgtaaagctctttttattcgcttcctccgccatataataaccatcaatcgtatacgggcctctggataataattccccaaaaactccttccggtacggtcttatcctcttcatccacaatcttcacttcatccgcaggagacaccggagttccctggcatcttacgatcagggaatcttcatcttccggactggtaaaggacagcagcccctccgccgtaccaaatacctgcatcagtttgcaaggccattcttcaatgatcttatctgcaagggaatcttccagcattgcgccgcccacctgcaaaattcgcaggctggatatgtcataatcttcatcccattccaacatttccatgcacacagtaaccatagcaggaaccaatgcggtaatcgtaacgccttcctctgtaattgcgtcaagaatatcgtccgggctggtcgcagacgcaagcacaacttttcctcccacatccagcgtacctaaaagccccgggcagcataacggaaaattatgggctaccggaagagacgtcagataaacgtcgctgctatccaggcggcatcttttcgcggacatacgggcattatacatataatccgtatgggtgcgcggaatcagtttcggaacccctgtcgtcccgccggacagcaaaagaaccgccgtttcatacccatccacagccggaaatgctctattttctccacacgtttccgcaatcattccactgatatccccggattcgctatctacaaatatatgccggatatatgaatatttctttttcatcgcatttgccatcggcacatatgaaaatcccaaatatttctccgccacaatataagcggccggctttgccagttcaataattccttccagttccgcctccctgtgggccggcagcatcaagatcggcaccgccccgatcttggaaagcgcaaaaaacacgaccacaaaagaaatcctgttcggaagctgtacaagcactttgtctccctttaaaatccctttacgcagaaaagctgccgcaagacaatctgctttttgctttaattccatataactgatctcgtcttcgctgtccgtgaccgcagttctttctccatatttttccgcccacttatcaagctgttctccaaaactacatctctcccaaccttccagatactcatatttgctcatatctttcttataacccatttgattcatctcctttcttatgcaccgccacatacgcagcatatcctttgatcctgaccggatacaggaaccagccctgatcattcctgcctttttctataatttccccgtttctgacagagaagaaatccattcctcttcctaatccaataccgagcgcttttacatacgcttctttggccgcccagtactggaaaaacaaagtcgatccttcctttattacatcttccgcttcttcttccgtataaaaattcccggctatctcccagtaatccggacatcccgccatttcctgcacatccactccgatgtccattccaacagcgaatcccgccagtatgaattctcccgaatgcgaaatattaaaatctacggtctgctttcctgcaatctttttatgataaggcttgccccgttcactgacagaaaaatcaatcgtttccacatctaaatatcttttcaagagaagccgcacgacaaccttcccggctatataacgcatcctgtcttccgaaaagcggaatcttccgacctgctccgattcctgctcactcaggatatattcatggttcacccagaaatctgtcatttccggccagcagatgcaccatatatgtatctcattttcacggatacaaagtttgcctgccgccagaaattccttcgctccataccgtttaatctccatcttttattcccggcaggcgccttataacttcacttattacttcgtcttcgtaatcccgcaaataaaaatgtcctcccggaaatatccggtagctaaaatcattatccgtatactttccccattcgcagattgcgctctcatccgcttcgccatccttttctccgccaaatgcagcgataggcgcatgcagtactattcccgtcttgtcataatatgtttcatccatggtaaaatctgcccgtagcataggcagaaagaaatccaataattcctgattctccagtatctcttttggcgtcccctcaaatcttcccagttccctcttaaactcttcatccggaagatgatagatcggcttcggctccggaatactgggaatccggctaccggaaataaacagacagctcgctgtatatccgaccgcttccaatctcttttccagctcataggcaatcttaccgcccatactgtgcccccataaggcatacggtccatccacaacctctcttactgcctcttccagatcatctaacataaccggcatatctatatacggcttctccatgatccgttcttcccttcccggaagctgaaccagacataccgttacttttccctgcatctttttcgcccactggttataagcagaagcgccgccccccgcaaacggcagacaaaacaaagttattttctctttgttaatattttctgtattttttatcaacttcaaattcacttttatgttcctcttgcatcatgttcttttttattctgtttattatcattttgtgatatgcttttcccaagcatttcttattcctatccaggattagttaactctaactctttgtcaaaaaaaatttttgatccatcccaatattaaaccggacgccaaaacaatatgcgctaccataatcccgtttacgaccaggaaatatccggttacagaaaaaacacctgctatcgcgcattcaataattaaaattgccctcgcgcgcataccataaactttcttttctttctcatccagtttcttactgctggcatccaccggtgccataacaaatatgactccaactgcagcaagccatatgatccgtatttgccacatcacagccgaaccagacgccagatactgaccgcacagaaggacaaggatactggaaacaaccatgcagctccctgctttttctaaatgaatccctccggcatactgccttagaacagtaaagggcaataaaaagactagcatctccagccaattccccgttacaatgccaagtatgacaatgataaggtatatcgccaccctgcccagcagtacgccgtaagcatattcatacagcctgcggtctttctcttcaagaatcccgttcctgttttgcacttcaaaaagccagccggtagtttttttccacactagaatttcctcattttcttaacttcttccggctcttcttcctgatagtacagccagttgcacgccagatttgccgtatatgccgtcaggcagagtgcaagacagtttacaactccaagtactttgatacccaagctttttctgattgtttttttcatagttacatgcctccatttttttccgatagtttacacaaaaatcgcccttttttcaattaccgtggcaaaaacggtaactttttgggcgatttttgcacatctttattttattgtaaagatcagcttaacagagaactcctgttctccgacctccactctcataattccagcatactttttaaccagttttccaaccgtatgcagtccgatcccgtgactgtctgcatctcttttggtgcttatgtaccggtccttgtcctttaacagtggaacaacatacccgttgcaaaattccataacaaggaaatgttcctcatttcccatatacatcctgcattccacatatcggccatcttttgtcttttctgccgcttccagtgcgttatccaaaagattacctacgattgagatcatatccagttcttccagaaagtccagcctgagatcattacccagggtaatcttataggaaatattcttagattccgcaaggaatttcctttcgcacaggatgctgttcaagatcgggtgttcgcaatacacacctttttgaaggctctgaatccggacacctaaatgttccataatctccttaacctcttgattttctccttcttccatcaaaccggctactgtacaaataaatttatttatatcgtgtaagaatgccctgttatcctcattgaccttattcatatactgtaaattagcaatctccgccctgcttttctggtatagccggtccatcttcttcacttcttctgatttttctacaaacctgtcaaatactgtgaaaatgaagatattcgtcattaacagaagcgaagctcctaccggaaccataaccctgttcattccttcaaaagaaatatttgaataaaacacacatcctaatataatgatcgtagcggttggcagcatgagcagcacagtaaaagttttattctcaatcgtcagataatcccttttccttgttacctgattaatgcatttaataaacagaaatgtcatggtactcatcagcaggagtgctaatgtcttttctgtttcagtcctgaagccctcggacgcaccagtcacgccatatgcattcgtaagtgccgcaaagagaaattcgggaataattgccagcacataatagcagcataccgtaaccagcttcttccatatatttccccggaacacaaccatagacgcaatcatatagattaccggaatcattaccatattaagtattgaggattccaggcggttggttccgaacattgccagtgctgcgatacaatatacgagaaatttttcccagaatctttctcttctgtatgggagtatgttcttttccaagtcctccaacagatacatctgaagaagacaaatcaaataatctcttattatcataccatgccgttcctttccccaagaaatgttatcagtgcgtcggcaaactgtccttttctcgacctcgaaacattcaactggattccaaacggcagcaacgcaacgttcttttccaatccttccacttttgccaaattcacaatatagctgttgtgtgcatactcaaatccccttccggccagacactcatacagatcacttaaagattccttgcaatgcatctcttctatctttccctgtctggcaatgtatatcgtacagccccttttcgccagacagatatataaaatgtcttccgtatggatgcgcattatccttcccgccgatgtaactgtcacggaagaatctccacagcacaatttcacttttaataaaatcataggtatttcctttttcagacttctgtcatgcagatccttcatgatgtaccggaacggttgtccaacattaatgctgtcaggagtcggttcaaaacagccggagcagaacaccaatatcgctgcttcattatattccctcagcttcagtactgttttatttccatccaatccaggcatacgcatatccataaaaatcagatcatgcaaaatatccgcatcttccaataattcttttcctgattcatattcataaaaccgtatctcattcgaagacagaatcccttccgtttctatgaccgtctttattttctccctgtattctttatcatcgtcgcaaattgctattttacacatattcatcctccagtgttagtttcttctaaccctttcccataaaaaaaccatcttgcagaatctgaatcctaagattatttgcctgttcctataactccggttccaaatctgcaaagatgggatcttcaaaaaattcctgtattgtaatatccaatccatcgcatatctttttaattgtaactacgccagcattcctgctttgtccatacaaaatatttttcagtgttgaaggcgggacgcctgagcgcaccgccgcttcattcactgtgatatctttctgcttaatcagatcgtttaaccgatatatgaccgctgtttttatatccacggtatcgaccacctttttttcttctattttatataaatcggctttaaaaggtcgcccatatatagtctttttgatctatgcacgatatttttttaacagtttttcttattctagcagaaatccgctaaatttctatattttattagatacatgaaaccctgtgagaacatttctgatcctacgcagggttttccactttgttataaaatttttatattttgcagtatgctggatcggagttatcattcaactttccttctgctgccgattgtaaaaacatatttttacgaataaatattcagcagttcttccggagaaagcagtgtaatccaaaaggaaagaaaatcctttttattccttgtcacaatcgcatcacactgattctccttcgtacaagttgcaagtaggcagtcttcaaaatcagatactctctgcaaataagcaggcagcacatcttcgttcgtcactgtcagcacttttgctatgtccaaaacggagccaagtgcctttctataaatttataccgttcttacatcccgatcagctcctctctccagctcatcttttccctgcttttcttggatttttctcttattgatttccagtcgttcatgaatagatggcttctttgccttcgtagttgctttattcttttctgtttgcatactcgaaactacctttttcacagctttgtcattatccccttttgtcacattcgctgctcttgacgcttctactctgctgtcctgcttttctgcaacctgccgttcctgcttttcctgcacacttttttcttccagactgcaaaagctctgcaaatatggcagcacatggttctgcatatcggtcagatcttccatacacttctgaaactcttcatttcccttgtttttcagataaccaatccagctttcatccgtaagtttcagttcattttggagtttcagctgacttaaaataccgccatttcctgttccaatatctattttccctttgaaatgttgcatcattttatcgcctttttccgcataatatatagtaaaaaacatctgggctgttaccatcggctcatccgtcctcggattacggtctgcgtaccattccttatccttctgtgcagtacgggaatccaaatctgagagcttctgacagcgtggttccatcagctctcgcttttcacagtaattcacatacaccatcggctctgtttctttggatatatctggttcgtaggatttcagccgttccagcaaaacacctgcccacacggactgctcacagtcttcttcaatcacatccttcagaaaggaaatataagaaccaacatttccactttgcagatccagcatgacttcctgtatggtatcctgccctggctctacatggtcccgatagtcatacggatcgaagtcttccgcaatctcatccaatgctgctgccagttcttctgttgtcatttttttcggatacattgcctcacgcacatcctgaatcgggatatatttataatcaggcaatgctttatgaatcttctccaaaccttcacgcaccaccggctgatcttttaaaaaccgcacattatccaagaagtcgccgtgtatcgttgttcccattacaattaacagttctgtttcatcaaacaagctatcctccggatcacgataaataatccccattccactgcctttataagcgttttccggatcttctctgtacttctcatagattgctgcgatttctttcacatctgtgcttttctcataagctcccatatcatgaatttcatcacattctgcagcataatattccagataagcttctttcttaggcggcatattattgagtacattatcaatcatgttataattggcctcttccagttcctccacctttgccaatggcttatattcgccctggcttttctgaatctctgccattacaacttcatccatttcttctactttctccatcaaccgatcataatctccacggatgcgttctccagtccagccttcgtcttccaaaagttcctccgccgcttcttgaatagaaatttcatcattctcataaacgccaccatccatcaagcggaaatcttcatcgtaaaaggaataatcatatccttcttctgttctctgaatagcaaagtaacgttctcctacctcatatgccagttcactaaggacctgttcttccagattcaggaaagaatctagctgttcaaaactgatactgtctacaaaatgagcagttactttttccccgtcattcagaactacgatatcactgacagacagggaatgcccacggaaatcttccggtctatcaatgttgaacctttcaaaaatatcatccagtgacatatttcctgataattcaccaacatagaccagcttgtaatcttctttttttatcttcataccatgactttcaataaaactcatattcataaaagcatagttttcgcccggtgaatcatcccggatctgataaataccaaatacccttcttgttcctaacaacaggtttgcttctttcaatgactgaatctgtggatatttctgcatttcccattccaggttacggaaacgctccagttctgtcatagacatctgataatgctctggtcctcgttcaatttccatacgttctgtgacatacatcggtgatgaaaaattagtgatcagatagatatctgctcctgcatcgtataatttcagtgcttcttcctgctcaatgacactcataggctcctgaaatgctcctaaattttcttctgcatgatctaggttgttatcctttatccgttcccacatctgcaattccattccaaacaaaccgtcgtgtgcctgtatcatttctttactcgcatattcacctttactgccatcacttccaaggcaataaatcttagaacccattctgtgataatccaaggctgcttcttttctaagtggcaccatatcttctgctgtatatccatagtcacgtaattccagcttacctatggttggatccagcagttcttgaatatccattcttgcgtcatccagcaaatcctctacaccttcttgatctgcctgactcactgcatctgccagatttcttaccaaattcctaactttctcttcctcgccgatcagattcgcatattcaaaaatctgttcttttacatctgttgaaaattctatatctctacgctctgcctgagcaatccgttcctgcgtatattcctgcattttctgcgtttcttttcctgttatcatacttctcgccattcaaattcctcctgtgttctaaaaaatggcataacaggcagaaccttcttctaccaaattatgccatctttcctgtttatttattccagaccgaagtcccgttttctgttttccttgccagtttcactttcccgctgactcttttctttataaatctgcagtttttcatggatagaaccacgtgtcggtctttcttctttctcatctgattcagacacctctgtttctgcatcttcccgttcatccatattgagcaatgcatttaattctgacagtcgctccagtttctggttcaactcctcttcttttggaaatggctttccaacctcttcttttgcatttgcaagctgttcatatactgtttccagtctttgttgtgcttctgaaagcttctctggataactgtccaacagattgttgatacgagtaatatttccaagtgcatctgctccaagatgaactttcgagacagcctcatgtttgacagatagaataaattctttactccatccatcaaactgaatcctcatattgaatccctgatagtttccgatatccatcgcagcatctacagctttaatatctttacataccgccagaagtgctgctcctgcctctttcttttctgtgaactctttgccgccaatctccatagtaaactgctctggatctgtgattttatgctctgagtaatgagcgatgtctgccttgtagctgtcaatgatttctgtcagttttgcaatctgttgtggaaaattccttgcaatatcatcttccaggcggtactggttattcatgtggttggcttttaaaagttttaattttgccacatcaacatccaatgccatcttctcttttactgctggatttccggttgcaagagctttgacctctgcataggaaagtgccgcttcgtccacatcttcacagcttcgcacaggtgctttgctggtcataatctgagaaatgaatttctgcttgttctcaaccaactgccacatgtagctgtcaaatgtggattcagttacataccggaagatatgaacctttttattatgatttccctgacggataatacgcccttccctctgttccaaatcagatggtttccagccaatatccagatggtgcaacgcaatcagacggtcctgcacgttggtcccggcacccatctttgctgttgagccaatcaaaaaacgaacctgcccggatttcacttttccaaacagctccgtcttctttgcttctgtatttgcatcatgaataaaagcaatctctttttccggtacacctttcgctatcagtttctgcttcaagtcatcataaacattgaaactgccatcacctttcggtgtgctcaagtcacagaaaatcaattgtgcagatttctgtgctgccgtgtctttccagatctcataacttttctctgcacagactgatattttgctttctggattatctggcaataattcgttcaccaaacgctgatccaatgccaattttcttccatcattggtaattttcagcatattatcaaccgaagcatctacccctccgtttctgacaacttctgcacgttcccccagactttctacgatttctttctgctgttccgttggtttcagcaccactgtttcatattccgcctctggcacaggaagctttaactgatcggaagtcttgatatctgcaatctccttaaacatattcatcagttccggaatattataaaatcttgcaaatcttgactttgcacggtagcctgttccttctggtgcaagctcaatgctcgtgactacctcgccaaaggtggaggcccaggaatcaaacagtccaagtcccatattttgtaatttgctgttctgcagatacctctgcataacatataattccgtcatgctgttgctaatcggtgtgcccgtagcaaaggtaatgccttttcctccggtaatctcatccagatactgacatttattaaacatatccgccgacttctgtgcttcattctgtgcaatcccggctacatttctcatttttgtataaagaaatgcgtttttataactgtgtgcttcatctacatataaatgatccactcccagttcttcaaacgtaactacctgatcttttttctctttctgattcagtttctccagccttgtctgcaatgtttttcttgtcttttcaatctgtttgacggtataacgtccaccatcctgttcataccttgcactctggattgccatttccagatcatcaatctgcctctgaagcatggcttcctgtttctcatcagagattggaatacgctcaaactgggaatgaccaataataacagcatcgtaatttcccatagcgattctggcacagaacttctttcggtttgccggttcaaagtctttcttggttgctaccaaaatatttgctcctggatataactgcaggaactccgctccccactgctctgtcaaatggtttggcacaacaaagagattcttttgtgataatcccagacgtttgctctccattgccgccgctaccatttcgtaagtcttcccagctcctactacatgtgccagaagcacattatcaccgtataactgatgtgcgactgcatttttctgatgcggacgaagctctatttccggattcattcctggaaaactcaagtgactaccatcatattcacggggacggatactattgaaacgctcattgtacacgcttaccagcctttctctcctctgctgatccttaaaaatccaatcttggaatgcagccttcaaggcatcctgcttttgtgatgccaacatagtttcttttttattcaaaactcgcacttcatccccattgtcatttacgactttatcatagattctaacatcttttagattcaaggtatcttccagaatccggtaggcatttgctctctccgttccatacgttgcataagcaaacgcatttcttggactgtcggcgttctttcctgtaatcctccactcaccatttacctcagagaattttacctgtatttccttctgtgcaagatacctcggcgtatgaagcagttccaccataaaatcctgataatccgaaggttcaatccaggtggctccaatacgcacttcaatctccgacgcttccagatctcttggctgaactgcctccaatgcacgcacattcggtgtgaattccggatgattctctgcaaaagttctcgctgtatttaatttatctctgacgtttccagacagatattcatctccgctttcccactggtctgtcagtggatttttgaagataactccaaccagctcttctgtgattttctcttcggtctttccggtcaactgtgccatatatggaagatctactttagccttttcatttagggacagagcaagtgcttctgtggctgtctccacacttgtcacagcgaccgcctttttaatggttcgtttggtgaacatgtccgctttccgcttcaatgttccatcttcattcaagtcttccagggaacacagcagacaataagaagagtcatcagaaaatgcacgtttgttagcattacttccaataactccatactttgctgtgtaggtatcatacacctgattcagttttttctgctgtttctggatttcttcgtctgtgacaaattcttccatctgcatggcgatcagttcacgaacggtatcacggattgcaaccatgccttttacacgttctgcagtgactgcaggcattttcacctgattcatcaaagaattgacacggtaatatacctgatcatctaccaccgtatagctgtaatttcggacattcggatctgccggaatactctctggcatctcatccagttctgcctctatatctactgccgctaccatgcttcctctgatgtgttttacaacttcttgtaactgtaattccagatcagctccttccattggagcacaggttgtttccataccatacggaccggacacttctttcatctcaccaagaatcaatcccggatgctgaacaaaatacttgttaatggtaatcccatttgcatcactctccaaattcacccagtctggcatcacttttgtgaaactctcacgcttctggaaaaacaaaatatcagcactgacttctgttcctgcatttgccttaaaagctgtgttcggcagtcggatagcccccagcaggtctgcacgctctgccaaatatttccggacttccggtgattccttgtccatagttccctttgttgtgatcaacgcagctacaccacctggacgtaactgatctatagtcttggcaagaaagtaatcatgaatcataaaattgtagcggtcatactgacggtcattgaccttatatgcaccgaatggcacatttccgattgccacgtcaaagaaatcattgggataatccgtcttctcaaagcctttgatctggatattggcatctggatagagaagtttagcaattctgccactgatgctgtccagttccactccatagagtttggactggtttagattctctggaagctttccaaagaagttcccgactcccatagatggctccaggatatttccctttgtaaatcccagattctccaacacctgatacatactttcaatcacaatcggctgtgtataatgagcatttaatgtggaagctctggctgcagcatattcttccggtgtaaggacggtctttaattccaaatattctgtctcccatgcagattttgtctcatcaaatgcatctgcaagacctccccagccgacgtacctggataagatttcctgttcctctggtgtcgcattgcggttctcatcctcacatttttttaacagctgaatagccataatattggctcggaatttctccttcggtgttccctgtccaagttcatcatctgtgatatggaagttcgttgctggaatcagttctgctattccgttaatctcttccaatgattctttttcttccaatacctcaacttctcccgacagttctttttcttttttatcataatctgtccacacacgtttagaaatagcagtaaaataggaagactcttcctccatgatttcttccttgatttcccgtaatttatctaaggtatccgcatttactgttttgttgtgataatgataataaagtacttcttgtccaagttttacatccagacgttccaattcttgtgttgacattcgctcccaaatatcatctttttccgtatgaatcgtgaaaccttctccatcatcatgatattctaatgtgtattgaagtcgattctcttctcccttaactttgcaagcaaaatcatagatttttgttctggtaccggacatatattctgaatcaactagtcgcagatccgttatatcttccgctgtaaaagtatcctgttccagctgttctcctaacatctgctgtgcttcttccaggtctgccagtctttgtgcttcctgtcgttcttcgtacttttccatttcttccggtgacaaataatcatctgtgcggattaactggcgaacacgttctgcaaccttgttccactttaataaaacttctacctctggactgccaattttcccttttgcaagttttaatccttttgcatcatgggatgcatcggaagcatctgctcctggtattccgggtgaggaaccacctgttccatactcatttttcaggaactcagctgcatctttcatatcatgatgttccatgaaatactcatagattcggttacgtcctcctgcagtaatgccgcctcttcttaacactgcgtcaatttcatcctgtgtgataaaggatagtgccggacgttcgaccgtaaatttctggtctacccaggaacgctccctctgaagatcctgaaagcgttggaaatattccggattatgctgaatctcccagcggtgataatctcccggattctcatccatatatttctgcagccattcaaaacgatagacaatcgcatctgcttcctcttgatctgtccatgctccactcactacatcctgccagtctgaatatgattgtttcttttcccagtttctgcaagtatcccgaaaatgaagtgcaagaagattggtcatttcttcctgctcctgttcaatggcattattggaaatcaaattatccacgtaatttccatcctcatacatatcccgaattctgttcgctgcttcttcccacgtaaccatgcggtcaaagtttcttctggcagagtcccctcgccggatacggataccatcattgtcataccagatactgattttctgaccatctatggtaaatcctttgccaccagttccatattcatctttcagaaaactccgcatttcttcattatccagaccttcaatcagtcttgctgtaatatgaaacagtgtatttttctgtccgcttcccgtgcggagaatatcatttaccacttcatcggaaataagaaaagcggctggctgttccaatgcagctgccgctttccttatttctcctaactgttcctcttctgttgggaacagacttaactgtaaataatctcctgaatcaccagctcctctgcctgtgccttgatctggttcatgtgtctggtccatgccatcccgtctgccattttgtccggtgccggatctttctccagaagttcgttcatcaggtcgtctactctctgtcttgcctggctgtcgatctccatcagatgactgtccagacggttctgcagtgtcagaatgttgaacctggctaccttgtgatttctcagatactctttccgcatcattccgtacttgccgatggttcctctcgtctcttccaggctgatatctggaatctgatactctccgttctggctgtaactgatctctctcatagtctgtttcctcctttttttcttctctatcttctgtgttatctgtattactttcacgcattaacgtgttaaattcattatagactacttctttttcttttgcaaccgttttcaggtcattttccagattattcagcacatatcgtccaatctgcatcaggactggtctgctgatctcattgactgcacttcccagatgtcctaatactatcagctgattaaagtccgtaatatgccgaaaatcctctgcatccagatattcctgtgcatccagtccacaccggtttagtaatacataccagacactattggtcatcagttcccgaaattcgacttcctgattctgttcgtccagttcttccagaaatgtccctgttacgtccagtctcagttcttccaatgcatctggaagccattcttgcatactctccttcgctgcctgatgcagactttcagcaagtcctccttctgtatcttccagtgataactgctcctgcagataatctgccaccagctgttctccttccaccggaagattccataactgaggatcctttccaagattccgcactttataagtgtcctgcacatcaaatacataccgaagtttcgttttcggtccggaagtattgtcaatcaaggcaatccctttggatccctttttgatccagcggtacatcttctgattccagatttccatggatgctacggcagttgcttccggtcgctgtgcataaattaaaagctgttctggaaaagtgtatttgtacagtctggatgcagtgtttaggaaccgcatccattcctgcggactggcagctacatcttttgccacctcttccgtcagctgttccattgcatataatttatttgccatgcgctactccttttcataaaatcagggactgcttagcacagtccccttaaaatcatcgttgttactctttataatgctgtggcaagctcttttgacttattctttggcactttgtctccctcttttgccttgatttctgccttagctttctccagtcttccatggattccaccttttacttccgctttttcggctgctttttctttctccaaacgagcttccctacgctcagcattttccataactgccgttttcccatcacaaaactgaactttatcggaaagctgctcctgtctctccacctttgtctcattgacttcctgtaccatcgcatttaattccggaacctgaaaaatgccgttatcaggaagaatcagcacttcatgaatggaagatgggatgacaaagtaatcacttcccaggcattccccaatctgtttacgaatatcttcctgcagtaacagggaagctccattcatcttagctttgtttgtcagacagaacattgggttttccatggcttccatatccattttttcattcagcaggttttctggttcttcaccaaaaatcatagatttgataatctcattcatatccataagtgtgacaccacgttttcggtctgccaccatcgcatccgcttgaatctgttcggcagatactccccactcgttcatcagagaaacagttaccggaatactgctgatcccttctccattttcctccagatttactgcataataagctgcaaaatctccgtgttctgtgactactttatctgcaagaagatcggtattccattccttatcacaaattctcatctgtaatttgtccttcatcttttcataatccagaatatctggaactcccatatcaaaaaattctgcttttccctgtgcctcaatacgcatatcagccacatcgccaacacaagagtctacatcttttccatggatatattcctggtagagggaatccagatagactgtcggtacgattctctgatctccattcggaatcgtaatacctgtcagcttcaaaccattgtttttttctacttcctgcagtttaatttctgcatccttataagactctggcagatactcctttacattgtctttgacatattcataaaattcttttctgttcatcatacgcttttacccctttctgatcatgtgatggttcattctttttctgctgaccatctgctcggatttcttctgataagccatcattctctttaaagttttctcctggttttttcgtgcttcccgtcttttttccattgctttcatcatagttttctgttcctttctgtgatatttttgtatgaaaaagggagcctcacatagaagctcccaatcataaccgttggttttagtttccttatttgcttttccttttcctgctgatatacagtcctgccatacctcctgtggagattacaagaagcaggatcggcagccagatattcgtgctgtcacctgttttcggtgcgtttgatacctttgtctcttcatgggattgtggtgtgttcggtgtttctggaacttccggtttctcatttgtcagattaaaggtaacttctacaaccggtgtactgtcatctgcataggcaaatgtcacttcatgcttggtctgatccagtgtgtatccgtccagtgtctttgtttccaccagataatacttgatagcggtatcatatttgccgttcttaaatgtggcaatctcatacagcttactttctgcatgaccggcagcatctgtctttaaggtttccagaacttttcctttgctgtcacgaagttcaaattctacccctttcagcggttctcctgatgatttatctgtcttattgagaatcacttttcccttggcagtgtcatctttcatagctactttctggatctctccagtatcctttacttcaaaactaacatccgatgtcagaagatatcctttcggtgcctgctcttcacgtaaggtatatttaccgattggaagtttttcgatatagtgtgcttcctctgtggaagtccagctctctactacctgatcatccttatcgagaatcgtcagtttcgcacctggaatctcagtttctcctgtgatatccgtcttactgatctgcacttttgtcacatcatctttcatctctactttctgaatctcggctgtattttctactgtaaaggtaatactttctgcagtgacatatccatctgccggttttgtctctgtcatggtgtattccttaccaacaaccagttctttgatcacatggggttcttccgtagaagtccattcatccactgcattgccatctgaatccgtcactttcaggtgtgcacctggaagttctttacctgttgtcaggtctgttttggtcagctccactgtggttggctgattctcaaaagtaaagtcgtagcttacttctgcctggtcttctccggcatattcaaaggtaaattcctgtatttcttctgttgtaacaaatccgtccggcgcaaagatctctttcacatagtattttccatctaccggaagatctgccgtaaaagtaatctgtcctttttcatccgttaccctctgctcgatcagactgcctttctcaaggagtacctcgccctttgcatttttgatatcttcactggtataaagaccaaagacaccacctgcaagaacacgttctgtatctttttctttcttcagaaccgtaacctttactttctgacgggcattctgccatttctcatcataagtgatgactggtgtgtcctgatcacggtaggaaaggtcaacatatctcggctctttgtccagcacataaccgtgggctgtttttacttccttcacatagtattttccagccgggagatctcccatctgtgcaataccattggaatctgtggtaatggttcctactttttcatctgctttgaaataatcttcactgacaccatctgccgctttgatatcttccgcagcaaatacatcgaaagtcacatctgaaaggcttccggttacatactcaaaaagatgctccacggtaccttttacatgatccaaaagtgtcaccttatccagaaactctccatttttgttgatgatcagaagtcctgttggaacttcatctttcatctctactttctgaatctcggcagtatcttccagtgtgaacttcacatccgtcgttttcagatatccatacggtgccatttcctctcgaagggtgtattcttcacccacagtcagtcgtttgatcacatgtggctgatcttttacagaagtccactgatccacaacatttccttctttatcaagaacggtgagttttgccccatccagttccacacctgttgttacatcagattttgtgatttcaactgttgtcggctggttctttttcactgttttcagttttactgtcttcacatcctgcccctggtaagaagcatccagattcagaacttcatcagaggatacaaatcccgccggtgcttttaactccttcacataatactgtccaagtggcagatccagcgtacatgctgcaagaccatcgttatcagaagtcatttcctgtaagagtgtgtctgctttcacgattacttttccatccgccttaatatccgccttgttatagataccaaagacagctcccgctacggttgcaccattttctgcatcctgtttttctacctggattgcaactttctggcggtcatcgccaaccgtcacttcctgttcgatcacaggtgtatcctgatccgcatagacaaatgagacatccgatctgtcatggttcaggacaaatccttccggtgcagtcttttctaccacatagtaagaaccaagcggcaggttatcagcaactgcttttccgtcttccccggtcgttaccgttgttaccagtgcatcttttgcatagatcagctgtctgtttctgttttcatctttctgataatccggtgtatagatattttcagctgcatagacatgaaatgatgcacccttcaggtatctttcttcataaacaaaatcctttttaaatccggtcagcatctcaccttttttatagatcgtcagttttccttttaccggatggttctcgtagtctaccgtaataatggcatctccgctctcagaatccatctggtatgctgtgtttgcatccaccgcaatctctacatagttcttattgattgtgtacccttccggtgcgttgacttcctcaatccggtaatgtccgatcttcagattcttcggcatgatcagatatccctggctgtccgtaaaataggacttgtgagtagttgtcactgggtaagttgttacctgctccacatacttcttgttgtccaggtcatataccttaaattctgttccggcaatcaatacagatttctttgtttcatcgtcttttttcacgattttcagttttgccttaaactcttcatccagaagcactctccagatctgtggctcgtttggatgatgttctgtgatattcacttcaaaatcatcgactggcttgtaattgtgcggtgttgtagtttcacgcacgatatagcttccaaatggtaatggaatactgcaggcataccctttttcatctgtgaaaatctcagttgctccattttctccactcactactggtttggcagaatcaaaatcatagcttccatctgctttctttgtaagagaagatttcagataaactgtaaatccggctccggataacagatctgcatcggtctttccattgttggctgccttgatgatctgaaatggctgtttgatgacctgctcactggaagtgcactctctttttacttctgctgtcatatctccttcataactgcacacaagatcatgctcttctgtatctgccaggtatccggtcggcggtgtgatctctttgacataatattttccaagatataaaccttttacagaagactgtcctttgtcatctgttgtaagagatgctacctgttctcctgctttataaatagttccggttgctccgtccggatgcacgatatcttcacgggcatacagaccataaactgcacctttcagtgtggcatctccctgtggtactgcttttcctgtttctttatcaactttgaataaattgatctttgctgtcacacggtcattgctgaaggtatgggcaaatgatacggttgcttctttatcattggtgtaagaaaacttgaacgtatacacatcttctgtatttcttacatagccttccggcgcctgatcttcttttacggaataggaatatccaatcggaagatctgctgtgaattttgctgttccatctgctccagtagttgctttctcaatcagtgttccttttttcacaacaacggttccgtctgcatttctaatatcatcggatgcatacagagcaaaaataccgccattcagtggtttctttgtatctttatcctgttttactacggaaacatctgctttctgtctttcgttgttaaaagtcacatctgcaaatacaacttctttattctgtccggcataagtcagagtcactggcttttcttcgctgccgttatagaaattgtccggtgcttttgcttctttcaccacatagcttccaagatgcagattcttcagtgtaacagaaccattctctcccgtagtcagattatcttttaccaggtcacctttgctgtacacttttgtgccataagcagttacgatatctgccccggcatacacgttatacactgcatttttctgtctgcggttttcatactggaataccgttccattttcactgacatctgctccggtaagaacttgtccttctttgtaaatggtaagctctgcaagctgttctttattttctacagtcacagaggaagtcttacttgctaccagttttacatttgttgccgttgcatttactacatatccctgtggtgctgtgatctctttcagataaacggtatcctgtgtcttgatgatcgtaacagaagattttccattcttatctgttgccggcatctgagtgatcagctttgtacaagcctcatcgctgtatacaccgaatactgcacctgcaagattgacatccgctgtatcgtctttctttacgatttcgatcgtagcctgttcaatccaggacacctttaagcttacatatttttcatcagcgacaccttctccaaacacaaatgccagatcctgaacacttgcattcgtagtcagtttatatgctgaataatcttttgtaatactacccttcatttttgcagaaaaagtagcacttacatcttttgtctgtgtcagaggtgctgaaagataaaacgtagttcctcctccaattgttacgcttgcacctgccgcacttacatttccagtagatacattatagagctttacaccctttggtaagtccattgtaattttctgctgggaagatgcattgaacttaatgttctccgttctctgaacatttccatctacataagcttttacattcggttttgaaaatgacatcgctacatctggtatttccggcttattcacacaataattatagagttcttttgccaaagcctcgcctgtagcatttgttccatagaatgcatcactgcttccattggcatacgatgcagccatgtgaataatgataaatctttttccttctgagaaatccgtgtgtttattcgcaaaaaaactttcgctccctgcggcatctgtaccgtaataacacacttttgctaacgcctgattgtccccgatctttgtgattgtataatttccagatcctggtcctggttttgctggctgtacacaatacgcagttgctctgacgcttccgtagctgatatagtacggctctgtcagataggttccaagattataatctgcatatctatacagaggtcctttttcaatcgttacctgctgtgtagttcttgctgaataagccgaaactgcttcaaatgttgcaatctctccctcttccatagaatcaagatccaccccttcgtctcctgcctgttccaaaacatcgtgaagctctaaccctgattcttcatcataggtatcctgattctgtgcctgctctactaaatcatcaaattcatcagcatcaatatcggtaatctccgagtctgcttcggaatcctccgcttcttctgtctgctgttcactgccagctgtttcggattcggttaccgcttcactccctgcagtttctgtctgcacttctgtttctttctcacgcacaatcagctttcggctgatctgatacttcggatgctcctgatttaccggttccacataatagaccgctttgtaagtgtccgcatgatctgtcgtaaaatcctcatccttgtcgttctttgcttcctcgaatgtgactttgaccttgttatcatccttgatttccagtcctgtgtagtctgatttcacatcaaatacactgcctgtttcgatttcataatctttggcagtcaccacctcatcttcatccagaaggtctttcacttcctcataaagtggcggtttttcctctggctggatctccgctgcatatgcagtcatcggagataacactgtactaagcattgtcatgcctgccagcaatccagatactacttttctaaaattaccttttttcttcatgctaaggtcctctctttcataataattgtattaaaacagacagtccttagactgcctgcaatacactacttatcgttgtggaaaaatcagattgaactgcacattcccctcgccgggatcaaccatttccacagttgcttcatactgtctccctgtttttcttgataccagatctttataatggatttttcctttagacaggaacttctttgctgccgccttatccatcttttttccctggcttgcaaggaatttatcattcttccacaaggtaaaagcacagttccgatcagaacagtaaaagtttacttttccttccctgacatcagctccacaacggggacatttgccaatgacttctccttttgcttttccctgaaactgctctttcttttcttctgaaataccctgatatctggcaaccagttcctgcatcagctctgtaatcccatttaggaattcatctgctgtctctgtattctgggcaatgtgattcaatgccatttcccactctgctgtcatcttcggagatttaatctcatccggcagaaccgtaatcagcacattgccatcatctgtcggcaccagatttttcttttcccttttcacaaaaccagactgaatcagtttttcaatgattgctgcccttgttgctggagtacctagtcctttcttttctgtatcttcggtcagttcttcattccctgcacgttccatcgcagaaagcagggtatcttctgtgtactgtttcggtggctgtgtaaaatgctccgatacaaaagaatcacagggaccataatgcttgcctgcccagatatccagctccggctcttctttctcactctttacgccaaagaactgtttcattttattttcgattgccttgaatccttcctgctttgttttctttgccgtgagataaaacgtatgataattacaggtaatctggcttttatgactctcataaatataaggatctgcggttgctgtcagtaccctggcactgatcaggtacaaaatcttgcagtttcgttctttcagtttacctatatctgcctttgctacttccatggtcgggataatcgcatggtgatcagatactttctttgaatttaataccttactcacgtccggctgatattccaggctttcagcataaggcatttccccaagtaacatctgaatcagagtttctgtgctttctcccatctcatctgtcagatactggctgtctgttctcggataagtgacaagcttctgctcatacatctcctgcacggcatccaatgtctgctgtgcggtatagccaaacattctgttagcttccctctgcagggtggtcagatcataaagcttcggagggcggactgttttctctttcacatcatccttttccacttcgcacatccgctccatgcagtccgcagccactttatctgcatcctcttttttctgaaaatgctctgtaactgcatccatatcatcaaacttgatatgagccatataatatttttctttggtaaattccttgatcttctgatttcgatccacgatcatggcaagtgttggtgtctgcactcttccgactttcagattctggttatacagaacggaaaaaagacggctcgcattgattcccaccaaccagtctgcctttgccctgcaaagtgctgactgatagagactgtcataacacgaaccgtcttttaatgacgcaaatccatctttaattgcctgttcttccatggaagaaatccagagccgcttcatcggctttttacatcctgcctgctcatacaccagacgaaagattaactctccttcacgtcctgcatcagtagcacagatcacttcatctactttagaatctctcatcagtttctttaagattccaaattgctttttcgtgccttccaataccttgtgtttccaacactccggcacaatcggcagatcttcatatctccattttttatatttttcatcgtattccgatgcatcgcataatccaaccagatgtcctacgcaccaggaaacgatataaccgtttccctccacgtagccatcttttcttgttctggctccaagcacggaagccagtgccatcgcaaccgatggcttttctgcaatcactaatttcatttactcctgctcctcttcttcatcttccagtacatcatcattaaaatcttcatctctcaggatttccggttctgcactttcttcctgctcatctgcatcgtctacttcccgtttttctgactctgaatcttcggattcctcttcatcctcttccatctcatcctcgtcatcatattcatgctttggtttatagactttgaagtaataacctcctgccgcagctccgactgcaaccaatccgatcagcagataagtccctgctgaacttttgtcttctggcatctgaatgtcatcctctactttatctttctcatctgtctctgccgtttccggcttttcttcttcagcctgtttctctggttctgcataaacagtatctacttccggaagtgtcactgaatcagaaagtgtgaagttcatcagatctttctcactgacttctgtaaggaaatacacattatcctgagattttgaattgtcaataatcagatagaaaatcttaccactcttcgttgaaatggtataaaactcttttgtaccttccgtagctgttttggtaacggattctgccgtctcgccttctttattaagctgttcctcaatacctgttactgtccgatcatccacggttccttttgcatctgtcggctcagaagcctgtgcatcctgtggaagcggagaagtcgttgttttttcagtccccgtcgcatctgcactggtcgtagttgccattgcaccattgctgtcactggaagatttctgtttttctgcctgcttctttgcccattcatagtaaggattctgcaacacatacttttcagaagtatttccagcaccatctgttaccgtaatctcaatctgttttgtagtaaaatctttctgtgtcagttgcactctcagcattccatccttcaagtctgtataagtggtgccattgactgttaccgcagtaatcccggatactgtatcattcccctgaatcgtcagcacaccatctgtcagggaagcagtgagtgtcggtttttccgtgtcataacacttaatagagcgattctgctcatagacctttccctcaccatctgtcacacgcacatacactgtctgatttcctgtaatcgtgatacttccgcttcctgttacatcctgccaacttccatcttttcctgcttttgcttcaatcttcgctattgagaaaccttccggcatatgactggcatctaccgtaacagcaatggttgtttctccctgtttccagccatccggtttctcaatcgtaatcgcaggtgcggtattctcagctgcataagcagtctgtgtctggagcaaaggtgttgtcaggcaaagaaatgtcgttgctgcaagcaagcccttttttaccctgcttttagtaattgttctcttcttctgtttcattttttccagattcatcatcggcttttgtttcctccttctgtatttccaccctgccgggcagttcatttttcattctctttttgaaagcttccaattcaggaatactcatatccattgcacggataattcttacaatttccagattttccgcttctgtttttgcaatctccgcagccttgaaccgctttaagtctgcttcatatctagctttggatgcttccattttttccttggctttctcataatccgccgttgctttttcaagacttttcatcgcttctcctttccggacggctgatgcagccgcccttttttcttaccatcgtccaaatccatagaaatggctctgccagtatggtgaattgatggacgtgtactgcaccggatgaccgcaatggatcatctgaccattgcctacatagattccaatgtgcgttaccggaactcctgcatcataagtgcctgtaaaaaagatcagatctcccggctgtgcttctgactgagataccggcgtgcagatgtcatacagtccctgtgcagtcaatcttcctgtattccttacaccagagtttgtcaggcagtaacttacaaatccagaacagtcaaatccacttggagaatatccaccccacacatacggtgttcctagatatctcgctgcttcgttcaacaaacgctgtgccgcttcactggtgtattcattgccgccaaagcctgccccttctccagtttccagataaaagatcgggtttaagcgctctccatttttcagaagttcaatatgaagatggcttcctgtagaatttccagtatttcctacaagaccaatctcatcacctttcgtgacggatacacctgcagatacactccggctgcttaaatgtgcataccgcagttcatagcctttactgtccttgatcacaacataattgccatagctgtcgttataagcagaagttgtaaccgttccggtcagccctgccattacttttgttccctccggcgctccgatatccataccattatgaagctgatttgctcctgaaattggatgaatccgatatccataataacttgtcacactggaataccagttaaaatcaaccggtgtcgcaaacatctgtaaattacctttcgtatcgttataggcactgaacagttctttctggaaaaatcccagcctgtcctgacagatcgacatcagatttccgctgtttaaggtgacattcagcacatctacatctcttgtcctggtcacttccacttcctggcttccattatcatctgccagatagcattcccaggtcttatgaccatgtgcggatgctgccgcatgactgtcataatagacatcaaactgtacaccgtatcttgcgaaagctccggtatcttctaccgtatattcgacaccattcatgaccacctttgttcccattggaacaaacggattggaagcatctactgctaaggtatgattggctgttggatatgctccactggcagtcggtcctccactccaaataccacaacagattggacagttacaatatccgcttgttacaacctgtcccaaagattctccaactcttactgttgctgtctctgtcacagtttcattgactgcttcagtagtcagatgatattgctctgcaaacaatacatccagttccggcttgacctgttcaaaagtaaactcctcatactttgctgacagataactgatcaggataaacggatcatgctcaataggtccgatgttatatcggtattcctcatgtcccggttcttcagattccatgttgttaatccgctcctgcagattagcttccagctgtgtataatacagttccgcttcccggattgcttgatccgatgacagataactggttcccgtgtaagtgatcacattttgtaaaaacactgcagagcatgacgtgacattcgttataatcagaaacatcaatccgatcagaactgccacactgatatacaccttccggttttctttaaagaaattggtgactttgccgccaatcttcttgatataatcaatcgtaccttttgtagctgtacctacggtctgttcacttcgctttgctttggcataatcccgtttgatctgttgcttctgaatctgtttttttagcttcttctgctcctgacgggctgccgcctgtgtctgtttctctgcctgtctctccagtctgcttctctttctggaagccctctgtttccttcgtctggcacttctctgttccagccggtaaataccttcgcatccttcttccaacttatgggcaccttctactgccgcattatcgtcttcatttttactgatctcacggtgcaatgctgcggaagttgcacttcctgctttcttaacaacaaaagctttttctgttttcacagattccccttccccaaacttcaggcgggatttcttctttccagaaccctctccttcatttgcctgataaacctgtgccttcttggaatgctgctttgcttcctttttctttcttgcttcctcataagaaaactttttggctttttccttctgtttctgatgacggaaattgactccatccgtatccatctggttcaatttctccatatctttgtcatttttcacagaagcaccagtctcttcataagcaaatttcagacgctgtttctgctttggtttcttacttccaccattcttcttactccggctgtctcctctgttttctgaaagatccgcacgtttttctttcagtctccctgactggctggcttcagatttttccgcaaatcttgattcttttctgttctcagcacggattcttttccggttttgttgctttctattttgtccaaaatcctcactttggttctccgttcgcatcagttccggtgcatccctggatttttgcacagagggacgaatatttttcccactccgcttagactggcggggagacttatccacaaggttttctgctttttccccctgttttattcccatctgcacatcactggcacggttactgacacgaacagaagatttatccgtcaggttttcttccaccagaccatctttggtcatcttctggaccttcttatccctgactttcattctctgttctgccactgattactcctccttcttcggataccctttccctgcctgtaataaacagagaaaagcgatgccaaatacagcaccgccactaaaagttaatacatatgaaattgctcgtaacatggtcttctcctttgatttaacctgcttcggaagtttcctccaagcgggttgtcatgattttatagagggaattcttcgggaatctgtctacaaatggaataatgacatttccatagaacagaagtccttccccctcattactgttggttacataggacagctgggttggtgagatattcagctgttttgcaagaatctgccggtcaccggaagcctggttgagcatataaataaaatctgaattttcaaatatattctctatctccctggaagacaacaaatccttaatattctgggtgataccagttggaataccaccccatttacgaaatctcttccagatttccacactataagctgcagtctgctcttccttcaaaagaagatggaactcatccacatagtatctggtggacttatgggcagaacggttcatcgttaccctgttccagacctgatcctggattacgagcatcccaatctttttcagctgtttgccaagttctttgatgtcaaagcagacaatacggttattgatatccacgttcgtctgatggttaaatacattcaaagaacctgtaacatagatctccaatgaagtggccagtcgctgtgcttctggctcttcctgttttctcagaaggttgtataagtcctccaggattggcatcttctccggtattggattggcaaggtattcctgatatactaaccgaacacaacggtcaataatcgttttttctaccggctccagtccattctttccgccaacaatcaactcacacagagataaaataaaatctgcttttaatgacagcggattgtcttcctcggaataattcaggttcagatccatcggattgatatactggtcagataccggtgaaacccgaaccacctgtccatgcagcgcctgcacaagtgccgaatactcggcttctggatcgcagacaatgatatcgtcttccgtaatcagaaaacagttcgtaatttccctctttgctgaaaatgacttaccagaacctggtgtaccaagaatcagtccatttgggttcttcaggcgtttccgatcaaccatgatcatgttattggataacgcattcaatccataataaagagcttccccttcctgaaacagttcctgtgtcgtaaatggcacaaagattgcggttgatgatgtggtaagccctctctgaatttcaattcgattgactcccagtggaatacaggacataagtgctgcttcctgctgataatccagctgttttaaggaacagttatatttctgtgcgatcccctgcacctggaaaatattattatccagcttctgccgcttctttgcggtattcataaccagaaccgtcacaaggaacattcgctcatttctggactgcagatcttccagcaggtttttcgcctcttctccataggttacaaggtccgatggaagcacgtccatatcataaccggaacgtactgcccgcttctgctcttcaatcttcatcttatccagatctgaaatcttgctcttgatcatcttaatcgcagaactctggtcaatggactggatatgaatgttgacattgatgctgtcatccacatccaggaaatctgcaagcatccggtctgtcagctccggtgcaagaatctgcaggtaacttacacttcccatcgttcttcccatcaaaaatgtctgattcttggaaaagttaaaggaagtcggtgcaataaaatctttggtttttaatccggtttccggcagcatcttatactggaacttaaatggttcgatccgatcctggttgaacacatgatacagaatctcaagcctttccagtccattcaaggaatgtgcctgtgctcccagaaccttaaagttgtttaagatatctgtttcgattctttcaagtcttggtcttgctaccttcagactctctgcttcgattccaaaagtgatatacttcgtctttaccagaccattatttcccttggaaagctgatttttcagcatagtacggtactcttcacgaatggcattgaagtcatccgtctgatccggaatatcaatgcttttttcaaattctgccacatccacctgctgattgatgaaggacagctgcacactgatggaagaatcaaagtaatttaagaaatcacagtaattctcaaatatcgtggtcttatcctcgtttaaagcaagctgataattgatgtcgtaaaactgaatcgtcttggagaaaaaggtctttgtcacctggcagataccatcctgcaacatccgaatatacggaatactctgctgtgcagttgtaggaatgcttttctgtttcctgcggtcccgttcctgtttcttcttacgcttttcctgttctctttcttttctgctttttttgtttcttctttcctgacggtttcttttttccgccagggacagacgctcctgctgagtctcctgctttgtcttttttgccatccggcacaccctccttttttacaagggtggaaatctcctgataaaaattttctgtcttatatggtcttactgccggacagataaacttctgtcgaatgatatttgccaccactttttcaaagggaagtccgtctttttcatacattgccatgaagaaaaacggaagcatgatcgttaccatcaaaatggcagcaatactggaaccgattggttttctcatgaacagataaaacggaattcccacaactgcggcaagtgaaaagaaaatcagctgccgctttgtcagatttaatgctacttttgttttgaccttggtaaggtcttttggtactggtacatacgccatggtatgcgctcctttcctgcccgctagtgggcattgaatatagatttgctaaggcttccggtcttgaataatgaaaatgcaagaatcacggtataagccgctactgaaaacatagctgcatgaagatcactggatatggtcattgcatttactaaaactgcataaattcccacacagaccatcatgaagaatccctgaaatgccagtgcgaacaagccttttaaatagttgtttccgatattgccccattccttattggtcatggtggcaaacggaattggtgctatggaagtataaaggtaaatttctatcattcttccgaacaagattaccgtaatgataattgacagaatgtgcatggtaacactgatcaacatcgtttccatggatagcaggaacaaatcccctaactccatatcctccagggcatccacaatccgtgaaattgcttctgttgcatccaccgcagtgtttcctgatatcaccccggcggcattgttgaccacatgctggccaacatcaaagaccgccatcgtgatattgaacgtatttgtcaccagataaatagctacatacgctttgaagatccagaggaaaatattgtaagtctcaaattcatggaaattgtttttctgtgttaccatcgtgatcaattcatagcacaggacaaaggtgatgatcagtcccgcaatggggacaatcactgtttgggataaattctgaatcagattaaaaatccctgtattccatccctgcggtgtctgtcccacctgcccggctatggttcccacctgctcattgacagacgtgaacatgttatccaaacatgacttgataagcccgatcaggatatcctttatcgcttccgtaattctctcaatgatggtgttcatctaccactcctcttaagagaacaatgttgccagctgtggaatcagggtagttcccagcagcatgattccggcaccagccatcagctgtttgatgccctggctcttagcgccgggattgtcatttccatatccttccagaaggtttacgacaccccacacaccaagacctgcgccgattgcgactacaagagtttttaaagttgtaattgcactgctaaaaaatgccatatattcataaaccaaaactgacttctttcaagtgtttacgggaatgaaaaaacaccgactaaaaagccggcgcacctaatgtcagttattcctttcctcattatttttcgttcattcccaaggttactccgacagttctacatgaatcacttccacctcttcttcgggtttcggtgtgtactgcggatttaactctttctctactttgtaccggttcttctcgttttcatctgcaagaagccgatagtttttgtgtttcgtgatatcatatttatccgagaaaaatggtctggcaccacggatctgcaggatacattttcctccatccatgactgcaatctcatcttctgtcatcagctgtttgcctgttttctggtaattcaatccaaaagacttctgattactcctcgtctccgaagtgttatacaggtcaatggtttccttacccagaagctcactcatttcctttaatgtggtcttctctttcccaccaaggaataaagtcgtatcacagttgcccagaatggtatctgcactatccttatacattgcctttaactgactctgtgactgcaaaataatagaagcagagatttccctgcttcggatagttgcgatcagcttgtcaaactgaggaatttgtccgatgttggcaaactcatcagcgatgacacgcacatgcaccggaagtcttccaccatattcatcatctgccttatcgcaaagcagattgaaaagctgtgactgtaacatggcaatcacaaagttaaaggttgtatctgtgtcggacataatcaagaacaaggctgttttcctgtctccgatcttatccagttccatttcatcataagacatgatctcacgaagttctgcgatatcaaatggggcaagtctggctccacaggatatcaaaatacttttcgctgtctttccagccgccattttatattttttatactgtctgaccgcaaagtgctgcggatctctttcttccagttcctggaacatcatatccaccggattctgataagtttcatcctcttcacgggtttcgctttcgttcaaaagatccagaagggtattcagattcttttcctcttcatccccttcataccagataaaagcaatcagtgctgtgtacagcaatttctctgctttcacccaaaaatcttcggaagctttttccccttcgcctttggtattcacaatgattgttgtcaccagcttcaggatatctttttcagaccgtatataagcaaatggattgtaatgaagcgatttggaaaaattgatggtattcagaaccttaatcacatatggctcatgaaccacttttccagatttatctttcataatatttccattcttatctttcttaggcggtccctttgctaacatcttcccgcactcttcgatcagagtacctttcggatctgtaatgaccatggaacaattcatctgcatgaccgacggctttacaaaaaatcgtgtctttccggaaccactgccaccgatgaccacgatatttttatttctcgcatacttcggctgctttggtctgctctccatagtcagtgcttctgttgctgtcaacggaatattcatccagggatcatctgacatataaggcttgatatcctctgcagttccccatctggctgaaccatactcgattcctttccgaagtttctttgcatctgactgtttctgccaaactaatagtttcaaaacaactgcgacagtaactccaaccaatagatctctcaggtcaaaactcaacagaatccctgtaaaaatccgatctgcatgttccatcgcatataacagtttgttccctatatcttctccgggactgctcctgtataggcaggatgctcgatccgcataaaaagcggtcagaacatagggaagattcgtaagaaccagtttctttttatccagggcggacagcctgaccccagctttattcttccacttctgcatcagattattgccgttttgtttcttcatcggctctgttcctgatgtcggctctttactttgtccttcgtcttctttggcatcattgcccggtaagctgcaagacgcttatgaatggaaggtttattcgctttttgaatctgtttctgggaaaactcacggaaagcagcattgagggcatcctgatcacgtcccttgaaaaataccagataaaccggcggctctttgctcttgtcttttttcagagcataattgatcccatattttctggcataccgttcaaaggacttgatatttttgtccgtgatctcgatattgaccatcccggcattctgttttgccagctcttttaccgtgacctttccctgtttcggctgatttttctgtgctttcttctctactgatttctgcttctgatgacgcagatacgcaacaagaacctttttcaacaggtctgccgtaatcttagtagcccgaatacagaacgtgaccgttttctgagttacctcttcctgcatgacttttccctcctttcagcgattcaactgctgtccaaatctgtaatcatggcaatcaccccctttaatgaaaaaagacagattaaccggtaatcaggttctgcacctgtacgagtttttctgtcccttcttcttttctcttatcttctccaccacaatagatgggaacacacatttcaagtattctactgtaaatacgctgatgggcagtatccaaatctgtggacttcatttcattcagtcccagattcgttgttatgatcagcggaagcattttacaatagcggctgtctatcacattatagacctgctccaaagcaaactcggaatttcgttctattcccaagtcatcaataatcagcagcggataatccacaagattttgtataatctggttcttatctgcctgatagctggtcatttcatttaaaatcctggaaaagtttgtcatcatgacacgttctccctgttccaaaagtgcatttgcaatacagcctgcaaaaaagctcttcccggttccaaccggtcccatcaaaagcaatcctacattttttctcttcatatctgtccagttttctacatactgcctggcgattagtatcttctggttgcttccattgtcattttcaaatttccattcccagaatcttctttcccgaagtccgacggattttctctgataaagctgccgctgttcttcttcccgctgcatcttctcatccagttcctgcctggcttttacctcgcattcgcacaaacaggacactacatgctcaaaacccatcagactgactttcatctgttttctttttccacaggtgccacaatgaagacatccctcttcgtccagataatctgctgttactttgttttccatcacaggctttctccttcctgaaattcatatttatccattcctatcctggttccatccctttctgcccaaagacagattgttgcaaaatggttttgatactcttttccactggatttcatataaacagaaagatgatcaatccgtttctggtaatcccatggaaatagcgtcatcaactcctgcagttcagcttccgacagaacaacatttttaaatctaccatattgactgaatttttcttccaaagcgggtgtattgcccttactcttatcagtatgattcttttcagtcttatttatcttagtattacttccatccagattcttgcagtccggacttctatttttttgcgttccggacttccagtttcttgcaatccggatttccaattctttgcagtctggatttccagtttctggcattccagaaacaaagtatcttactggctttcctctactccgttttacaaaatttttcacatatatgacagagggacgattattcccctgccgataccgctcgatcaatccaatcccatgcacactatccagctcatatagaagctttgtcactgtcgtatgcgacattcgcaacagctcctgcaattctgcgatcgtgtaaatgatatagacataaccctcactgtcaatccagccatttttcttggacaggctgattcgatcaagcagaattccataaaggagctttgcgtctgtggacaggcttgcaaactctttttctgtgaacagagcttttggtatccgaaaaaaagaaaactggtcagattcttctgctctgaaatattcaaaatctgccataatattttcctactcttctacatcaaaatcacaatttgctgcactgcctgtaccatggcacatctcatcaaatacaaaattgaatgattgaatcatttcgtccaaataataatttctggccttcttgttacaagcatacatatcaccaataaagccttcatcattccccatcgcatgaacaagggtttccaggaccttcataaacttcttttttgaacagctttcatactgtctgttcacatatttctggatatctaacacacgagcaggattattttcattttcctccagaattccaaatgcaagatccataccaaactcatatccatcagccttaatttgatcaatatccatctctccaagctcatcctggtatcctcgcttttccattgcagttaaagacgtttcatattgatcaatatatcccatatccgcaatagtttcaaaaatatctctggatgctttcaccatcttatccataataatttctctttcagccagcggcatatttgccatgatagtatctaatgtcatcattgattcttcctccatctcattttcataaataccattgatataaaagtggttcgcctttccattgtttggaatgatacgcaccagtttaccaacctgaaccagttcctgtactgcctgatctactccataccgagtcgtattcaggtctttctttatttcacttttgggatagataacaaacagattcccgttatgatctacccagccattttgcaccgcaaatttcaaacgatccagaaataagctgtatagaatctttgctgtatttgacagatttttgtatttttccatctgaaacagcacctttggcacctgcagacaatctaccggcatatactccatcttactcattgattgtttcctccttctgtttgtacagcacttcggctgaattaatattgatttccagcatccctacaaacacctgatagtacagcaggcatatctgttcatcctctcttgccagatacaatccttccagttcattggacggatgtttcattccgtatactgcctgacagatatcatggattttctcacattccacacttctaagatgcatctccaaggtgtgattaaatctctgccagtcctccagtttctgatttactgccatcatgcactggaacagttccgctgcttcacatgctgctgacagcactacatttttgttgttgatacttccatcggcatttttcatatgccctaccatatacgcctgatctactgaaaccatcttttatcctcctctatctaaacggcatttcttcttccataccctctgggatctctaagaacccttccgcatcttctggaaacggtggtctgtcaaccatttttgcacctgcgaattcaatccggtttgcatacacttcggtggtatagatctttttcccagtatccttatcttcataattacctgtgacaatctcgccttccaccatgaccttcgttccctgcatcagataatctctggcaaattctgctttctttgcaaaagcctttaccggaatgaaactgacttcatcggaataatttcttctgactgccagaacaaacttggcaatcttatgaagtcctttttcattctccacttcgttgtatccgggatttcttactaatcgcccggaaataactgttgtattcattggcttacccctcctatgctttcattgatttgtaacagataccgatacatggtccacattttccataggcacatccgtaacattcatctttttccaactcttcctgcttcatttcatcggcaaacattcctaacagtgttgtgtaaatctttttcattgccaggaatttttcttctgctttttccatcttctctttgtaaaatgggatcagttcacgaagaactggatggaaacgttcattttcatcatcccaggcacaggttttcatcatacagcgtggctgtttctcataattgcccagataatatgggcagaacgtacagcctctttttttaacaattgccaccggaatcactggcatctgacttttgatttcctttgttacatgcttactttcaattcgctctctcatcttaaaaatcctccaagaatatatatatttgcaaaagggaattcccctgaattgcctgtttttaagcacaaaaaaagaggcagacttacgatttttattttcgcaagcctgcctcttatcaatctaatattctattttccaatgacataccgtataaacacgtatatcgctctgatcacatacactggaatcatgatgcttccaatcaatgctccaataatgacacttaatgcagccatcccaagtgttgctgtggtatccattcctctcggaattagaatcaaccgcattttatgtattccaaatggaagtccggcaataaatacccaccagaaccaatccgtctgcccactgaccttcataattgtttttgtcatccaaaaccagaataccataaatgccagtggcagaattgattttttaattacatcttcaatcgtcatctttttttctccctctgtctgattccttccgccacctcccgattaaggtttgccagtatttctctaaccacaggagaatccaatcgaaaggtttccagatctttctccgtaagctcccttccgttcgcatcatatcttcgtacaatttttaaagccatactttcacttccttcctgctgataatcctaatgttttcaacaaatgtttaaatttctctctttttatccgtttaacacgtatcttttctatctttttcagatagacttgtattctacttgccatatcttcattgttcattctttaccctctctttctgcccacgatgccagaagcataaatataatttcttccatctgagtctttgtatatgtctctggaaaatattgtttcaatttcttcgccggaatctgcacctgaactttttcaatactttcattcatgcaaatctggtcaatctctgaatacgtcaacatccgttcttttgaaatctgtttcaattcctttgcctgcttcatggacggtactatattgtgattatgcatatactgaagtaatatctgctgctcttcagttctcaaataggaaacttcaacagctgtattaaagggaagcttcttctcgtctgccaattctaaaaactctgcgatcaactctgtcagatgaatatatcgaagaatctgtctggaactatctcctgtattctgactgacttcttccgccgctaacttcttgccaacttggcaagaagttaaatcagaccgtttcccctgacgctttaacgcctcatatttcattttataagcgaatgccttttcgctgattagtagctcttctcgctgaatgttggaatctaccatgatcaccgtcgcttcgtcatctgtaatatctttgatgataaccggcattttctctaatcctgcaagttcacatgctcgttttcgccgatgaccagctacaagctcataaccaccggactctctcaaccgcacaataccgggaaccaacacgccatattgtgtaatgctttcagacaattcctccattttcttatcatcttttacttgaaatgggtgatttggaaacggatgaaggcttcctattgctatctcactgattccattggttgtctcttcgcttgttccaaacaacgcatcaagcggctgtaaggaaatgggtgttgctctttttttagatggcatctttcagcacctcctccgtcactctccgataagcttctgtagctttgcctttcggatcataagagaaaatactctgtccttctctgactgcctccttcattcttacggaaaatggaatataattatcaaagatattaatttgacttccatatacatttctgagaagttccatattattcctggcatcattcgtatgagcatccaccatcgtaaacagaattccaccgacttgcagcttcggattgatttgcttacggaccttaccgatcgtttttaataactgctgcaatcctttgattggcaggtaagacgcttcaaccggaattagtacttcatctgatgcagccagtgcattgattgtgatcattcccaatgatggcatacaatcaatgataattgcatcatattgatccttgataccatataaaatctgtttcaatacatattccctgctcattgcatttaccaactgtacttccgtacctgccagtccaatgttagaacagataatgtctattccttctgcctgatgcctgatataacagtctgaaggaatatcttcatctttcattactgtatccataagagctgtaagtgtttcattactttcatcacaatcacgatatccaaatcctgcggatacatcagactgtggatctgcatctacaatcaacactttcatattcttttgtgccaatcctactgctaaattagctgtacatgcggattttcccgttccccctttttggtttacaatagaaataattctagccattttttcatcacctttcaatcaataaaaatgaccgaatcagctaaacagattttcatccattacgagctaattcggtcctgtttttcgctattaaattgtaatatcaccactttcgtgatacagtaaaagcatctcagataaaagcggaaattttctttcatctgaataagttttttataaaaggtaggcctttccttcataaatttgttgattcgttgcaagtttttttcaggaccaaatcgactcaaccccttgtatttactgggtttccgttgatttagtcttattttatcatcatcatctccaatacgtaacccccaatcaaaatttgacatgatgcctatacacgccgaattacaattggtttcataccctcgcattagttccgttaaaagagcctcaatttcatcaggatagaacaccatctctgaagatggctttcttctagggctagacagaaggccctataatctaattcttcgcttatccatgggttatccgttatataccccttcttctttgcataaagcatggcattcattactacaattttatgcgtattgaatgcttgggccgtcatgcgaaatgcggtcagtatatcaatggcccatttttcaatatcaatagtggtaattttttttagaggaatcttatcgattttcctattttcaacatattatatatcaaatcgatatgataaaatgtaatggcctgggatgtaaatcccaaagccattttgtctacaatctgagagtccgcaaaagtatacttttacgggctctctttcaatataaattataacaattttcagttaaacataaattcttttactatttgaatatcttctaaggtatcataagatttcatatcaatcccatccataaattctaacttttcaataacatcttcattttgctcctcatctaatatccagtcattaacttcataccattcgctatgttcctctttaagaatgtctgtaaatcgtatatttatataaaaatagtcgtctatatctacttcggaataatcttcacttaaaatatcctttagctctcttcgcatttcataaatataatatgagtttcttaaattcatcgtagcgctgggatacacattattttccaatagattgaaatataaaacactatcataaaaataatcatttaaatatacaaaaattgagtttgcataatccttatctacagtaactctcagtatctcatatggatatataaccgcatttgtaatttttcctcccttattcgatatttgaagtgtagctttattttcgctacgtatagttttattcaggtgaatttttaattgtggcatcatgcttgagtcaccattcctaatgtttttaatgacacaaggaccagatgcagctatcattcgttctaaacttccgataatcatatcgtctgtatatccaaaatgtgggtcagaaacaaaaatagcgctatcaaaggttcctgaatactctaaatcttctattatctcatcaaaatcaaaatcaatttcgcccatatcatccaaacccaaagcatagaaatccaaaaagtcagtaacaaagcctgtatcatcccttccaaaagatacttcaaaaaacggcattctttcttgcatactaatttccatttcttttgaggcaagatccgcttccctagatgcgatttccgcttgtctctcattaattgtattcgccattgaagccactttaatactagcatatgtcagtgttgccgacataactgtccctaatattgtaaaaatagttctataaacaacttcattcttagtaagagataatgtgattttcccccaagctgttaaatgctttttttctgatattaaatcaatttcatgcgtatgggagtcgtaatgtaacttcgtatctttttcattcttcatagcttgtaccacctagtcgtgattactatttgaacatccctcttatgggttacacttcttgcaaggctcatatcagtatctttacgattggcagttggcaagctcccgcatgaagttctatgaaatttcttcgtttttgtattaatgcacatacgtaagtccattcttcggtgcttctgtaacaggaaccgaggctgttattggagcaactgttttttctggaaccttttcttcatttttatttccagttttacctgatgtaccaggccgagtatttcagttcatatccgtcccatttgatgtcgctattactatcccctgttcatctgtccggaatatctggataccctttgcagataacttacccgtagtttcctgatgcggatgaccataagaattccccatgccacaaacaacagtatctccctggtcattttcaccagcatcaaccaacatgttgtgattgccagactggataaagatactgtccccctgacccacatcaatgaaatgaactttaagttctgaagatgtctttgtagcctttactaaatctgtatcgtttttgttaatctcagctcttacagatatatcttgtatcgtccttgctgagcatccggtgaaactacttatgaataccaatgacgttagtaaccaaataataccttttcttgctttacttatagaccttccctttttaatccctcccatattttctattataagtgtatcatctggtttcagcataggcaaccaaataagctattattttcatcttgtaacacaagggactcccataaaatataggagtcctcataattgttaatataattagtatattttacattaattattctatccattcccctttctcatttacataatagccatccggagtaaccgtattgtacagcagccgtccttttgtaccatcggattccatattgaaataataccatttgtcatcaattaactgccagccggttaccatactgccctgggttgagccatcagttggtaaaagataatattgatttccatctatatcggtataccagccagtctgcatatatccttcctcattaaaatgataccagattccattcacttctttccagctacttgtagcccaggtctggtcaggatttttgagacgccatcctttttcatcccgtatccactttatagtcggaactgtaatgattgagccgccgcccccggatgatgaagaccctcctctggtgatgatttcttcgaagttcgctgttactgtgctgtttccagagagaataaacccaaggaccaggctatttcccacctccgcaccatcgcgtgtccatccggtaaaatgatacccagtgtctggaactgcggacaggattacttcttttcggtcaaggtagtagccctcaatacctggattcttaacatctccgaatataattttacctccactgccaggcttaatgtcaagtaaacttccgtctggtgccgtaaaagaggtaagcggcaagttgctgcaggacaaatccgtaaggctcgtcaagccggataagttcagctctgtcaactggttattgctacagtacagcattttcaatagaggtgagccggatacatccagtacccccgtcaactggttatcgaagcagcccagaatagtcagggatgtcaggccggacacatccagcctttgcagccggttatcgaagcaggacagtgctcgcaacgaggataaaccagacacgtccagtgccgtcaaccggttatcgaagcaatacagagaggtcaggttctctaggctctctaacccgttcaaagccgtcaactggttattgccacagtgcaactccgtcagttccgtcagcccagacacgtccagcatccccttcaactggttatctccacaggacagatgggtcagagatgtattctttgatacgttcaatccagtcagattatttttgccacaaaacagtatgcccaggttagttagggcagaaatatccagtgtccccctcaagcctttttcatatatgtccacgtaagtgattctttttggggtgctactatcccatcttactaagtcatctgtttcccaacctgccgggtcatcttttgtggcagagaggtcattattttcaatgatgccattgataaccgccacatcgccgtcatggtagccgtcattgtttacatcatcggggttggctgccgcaaagactgcctttatggacatattgtcgttcagcataaagataaccggattatcgagatatatgccgctcggtatccgccattcctgaaaggaaaagtcggtgtcgggacttgccttcaatgttatcttgttgttgctgaaatcaaaggcagtcatccaaaccgtgccgcccgtcgtcttatcaacggttagggtatggccgtcctttggtgtgaatgaggctaaggggttatattcgcaggacagaatggtcagattcctattttctgacacgtccagtgtctccagctggttaacgccgcagtacaggtcggtcagttccgtcaaattctccagcccgaccagcgtctccaactgattattttggcagttcagcccggtcagtttcttattctctgacaagtccaatactttcagctggttcttgttgcagcccagcttggtcagttccgtcagctgatccagtccgtccagcgcctccagctgattattttggcattgcagactgatcagggccgtcaaatcggacacgtccagtctcccggaaaggccctgggagtttaaaatcagataggtaattcttttcgggctgctattgtcccatactattcccttaccagtccaatttgccgggtcgtcctttgagatgaacgtcaggctgtgagtgtcaattatggcattgatagcctccacgtcattcttgctgtattccgtaccgacgtaggaaagagtgtccacctgtccgccaatccgcacatagatttccggcagttccacatctcccgcgcaggtgtagccgtctggaagaacaggtgtaaagatatagctgccctgttcggcggtgtcgtcataaacttcgtctggctcccatgtcactcccttaatggtaatcggttccggtgtggggacggtatcgtcctctatggtgtagccggacgcgcccagcgtggcgggcaggttcagctcgtccagctttgttccgggtgaaacggactgaaactgtaccttctcgtccaacacatcaaagtctgtgatgatgagcgtctctactttcccctgctgattcggaatctgatttggtacctccgtcccaggatgcttatcctccggctccggtatttccggcaggacgttcccgctgtccgcatccggctcctccttgccacatacgtcacagataaagtcacaggggtggcccttcactgcctcattgtacccgcaatcatcgtcatgctccccgcgctcatgggggcagtccagttcatagcacttctttttgtgtacatgggtggcggagctgtccgttgcccaatccatatcctcatcgtcatagccgcaaatcagttcgtccgtataacattcgtccgtgtggacgtgttcacagcggtgacccttgacagcctctacatagccgcattcttccgtatgttccgggtggtgttcgcatagcaccccccccccccggttgcttgacgacttttcctccgcatacacggtcatccccatctgtcctgccagcaaagcggcgcacaacaacaatgaaagtccacgtgcgagtttcttatttttcatccttttccctccttgaattttgataatattgctacatttatgtttagtacacctcctcccctaagatgaacaaatccgttcatcttccctaaaacgacgaaatgcgaacggccatagccattcgcaatctcttgtttaattatatcaagttctggtatggctgtcaaaactaatttggggaacttatcacttggtcatagtttcatcatctatcggataggcactcgttttccacatataacacaaaggactcccttatttggggagtccctaattaaaattcagtttttgataagtttattgcactactgtatccattcccccttttcatttacatgataaccatcaggagttgtggtattaacgaataggataccatcaactccaaggtaataccatttgtcctctaatttaatccaacctgttttcattgcgcctgttgtagggtcaaaataataccatgcaccatttatgtctttccacccagtagtcatggctcccattgtcccatctgaatcaggattaaggtaataccaataaccattccataaaatccatcctgtcatcatataaccgttttcatcaaagtaataccaatcataccttttattataatcaatataatagaatccattagatgaccaagttccgccttcatacctataccaccatcccttatcattcttttcccaagaaccttcaacaatatcacttaattcatctctgtttatgtactgatttatgtaattagtcctattacctattatgatttcaatcccctgcacgattttaccatttatatcttctaaattaatattattaaatgattgaatcaccccgtctttttctatatttaattcggctatttggattttatccgtgctaataactatatttttattaattaatatccctatactttcatccgttttaacataatcgctaatagacacggcaatccgttcatcattctgttgtaaacatatttctgtattaccagtccctttgattgataactcaccagtattacagtcaaatgccaatgttcctccatcaatcttccctactgtaacatgatgttccgataataacccaaaagaacaggcaccctttactgtatacggctgaattggcatattaaagaaaccacctaaatctcccccaccttcacagtatggaacaaactcacatatatctgaacagtataccaaatcattattctttacttcggccattttattattttgacaatcatataaagaataatcacttccattaaaatatataaacgccttgagtggatcatattccaattttttagaaaaaaaattatcgggtagtttgctcaaatcataaaaatacatgttactatttgtattaccacttttcctttctatgccatgtgaactatatatccattgacctgattccgtatttacatcaaaatatgctgtggaattaaggtatgaatcatgaggattttcaagcattacactattattgggataattgcagtcatatataggtattctaacccagccttctcccatatctgtaggttttttcgctgtttcaataactactgcatgatgggtctttgttatacagaatactagtggctttgcgctactactattcaaataatcaataaggtccctataattattttttgcataatcttcaaatactctacaattttttacatccatagaattttgagatatcattaccctttcaattaattctattatgtctccattaccatccagagtgaaataatccttcccctcctctgttttatatatatcctgatatccataataatataaaccgatatcctgtccagcccctgacatataatcatccaaatcaattttaccaatataatcagcgactgctaatgttgatagtccgaagcaatttccactccattttactattcttgttcctgtaagttcaagcaatgccattatatccaaaccatatgtgtcactataacgttcgactggaattctgtaattattatcatatccaaatcctaatctactattggcaatacaccaaccgtcagtttcggtactaaaaccatcatatccctcatgcatccattttgcatatattaccaaatcacctactgtattgagtccaattaaatctattctgctgttaactttaaatgttggtgttgtataccatcctccaaaaatataatccttacgggttggcctttggagaacaacaccatttccgcctactacatatgttgctggatttagtgaatgatttattcctccatttaacacatacgttatcgcgtgtgtgtttccagtccatattgcgttgattatggtttcatccgtaatactactaaaatccttatcccatgctaacgtatatccatctttaattattgtcggaggtgttgcagctgtaccatcttcaaccattacttctcttacaattgtatccccatctttaaaagttactttgtattgccgtttctgactttctgttactgtaactctacacatcgcaatatattgtccttgaattgcatagatattagccgtaccattactcattgctgataatttaccatcaaccccaattgatactactgatggatttgtggatatccattttaaattggttagattgtcgtcaatattaataggggcaacctccaaatccttaatatccccaactttcatctccaatgcagatttatcaaacttaattccagcgtttaaattactgtctgttttattaaggccaaagcgttgtgaatccaaatccagcctgagcattggacggactcccagtatccagctgcaataccgattcgctccatagccgcacagccccttttcagttacaaaaactggccttaacaatgtgtaatttaaatctcccctactacgcgtccaatagcttctgtcacttgccgtattactagaccttaaggaatcattattatatgtcgttttgcgtgacaggctttctccatttattgggaatccataaccttcatcagtaagttcttcctttgacgggagaaaaatcttgtcttcagttgaatttccttccggcagattactgtccgaattaacaatatcggtaaccgtactttccttaatatcggtctgttcttcaagtgtgaaatgatttgccataaattcatcattcagccagcgtctcatatcacttgtttcccaggttggatggtcattatttgcagtcccataattataaacatccaacatctcatctgccaaaagaagtaaagcgcttccattattattcaatatcctccactttatgggcgtcattaaatctgcgccggaatacaattgcccattaagcctataaaattcacggtcattaacgtagtccttaatttctagccagttgtcattcccactatgcttgttgctctccaatccttcccatccgaaataaatataattccccttccagtcaccagaagtggttccaccaatcaaaggattccctaatgggtccgtatcctgtgtatatgtggttgtgaaaccatatacagaaaaatggtcagcttcaaaacttatcccatcactttcctgccttgaagggataagttctagattttgatcatcatcaatatgaaaaaccgtggtttctccatccacagaaagcttgggacaaataaaggaaacatttacctttccgttctctatctgtatctcatcattaccatcccagaaactgatatcaaatgcaacggtttcgtccttcttaaatccttcgattgaatcacgcaggactttttccagttcattatcctggttaaccttaattattcttacttctacatttttaggaagtattccgttgctcgctgttatatggatggttataccatcaatagtctcttcataatcaaacccccaatagagagacacagtgattctcttgatattaccaaccataaaactcactttatctggtaaattctctctggcacaattaatggctaatgggatatcaatgtatttatctaaatcatgttacatcttcttcatcttgttcttttcttgacgcattggaattggaggcaatccccacttcttcgtcagagccatcctctttgtcatcatccctttttccattggatgatgttgctatgccttcgtcaccaattgtctctgcatagctaaatttgggcgacatatcaactgccgaaagacttacgacaagagcgcctgttaacattaatgacaatgcttttttatacatacttatttcccctccttttaaatctatcaatataaatattagcacattatttgctattaccaaacaaaaatattagatattttgtgtgatatatctattttttcacttattttaccatcttgtaacgctattgcaactaaattataccaacaaaaagcggatgagccatcgcagccctccgcctgttcttatctacttatcaatttcacatttatataactttactatgcatttaatatttgagttgtaaatccctataaaaccatatttacaaaaaagtataaaacataatttcatccttagaaatcttcatatacaattttttcttaatttatgctattataattaacgtaaccccttcaacacattatagttttgttagcccccaaaagaaacgaaataccttctcctgaaaagaccagttccccgactggtcttttctctccccgtagactttaaatagccaggatattaatttaacatcattaatcaatattccttttgcattcctccattccatattccattcttgtccacgtaccaaccatctatccacgtatctaccaacataattcccatctttccatctgaaaccggattaaaataacgccaaacaccgtcaatctgctgccatccggtcctcatcccataattgatatctacgcagaaccagccatcataatatgcatcaaatatcataccatcttttaaataacagtccgcaccaaatgcataccatactccattaattaactcccatctgtaatactcagactgtttcccagttgaatctgtttcccttcgcccctgtgcccatgtcccatctgctttctgccaacgccatccaatgtcatctttcagccacttcccatttgtcacgggtgtggtataatcactaccatctgaggaaacatccgaacctactacattataatcatttatggaaataatcctatcccccatataattatcctgcacaacaggaatgtattccacgcttaggacatgattgcctgctgaagggtttttccacgttgcagatgacagtaaatccccatctattgggcactgtgctatcgcgacaccatctgcactgaacttaaccatccctttggggatgtcattacctattgtcccgcttatacctgcctgcagttttatctcctgcccggcccgtgcctcaaccggttctacctccaaagataatgacagttttttaggctggacggttactactatgtcccccgttgctatactgtataaatccccataaatgcttaagggtctgaatgacatcttgtatgtcttttccataccgtcttttaccgatggcacaatggtatcatcgctccacacaaaatccccatccagtatcctatggtcttcatcaaatgcctccccgctggaaatatcaccatctgcaagactttccccatatgtaaggatcacttccggccaatccacatccgggacaattgccgtacctatctcaacatatctggcagggccggtactttcatcctcacctatggtattgatataaatccatgcgccataaatatcagggttcaggagcacggtaaagcactttccaccctttcggattacaagcccgtcccctagttcaatctcctgcggaagttctgcatacttagggtcatcatagtataacttttgaagctggatggcctgacagtgcgcttctgccttatcaacgtctatgccgtccacgtcctcagaagcagatgcggatgctatcagtgtgctgcccggttctaactgtaatgatgtgaactgttgtttacccgagttctccagattgatacagattcctgttcccgcagcgtttccccctccatataaatcatgtccatcagtggtggcgtctgccgtaattgtaccggaattgatgatggttgcatcccctgaataattaagcaggtcgattccatagctatatccttccaaaccactcgcagtcaaatccccctgattatcaagggtgacactgccgctcccatccatttcaaggccaattgcatgctcataagtaccgttcttccctttatttgtagccttaagttccatcgtgccgcaattaagcacgtggatatccttcccaccaacaattgaaaacgcattagaatggttagaccagcgcgagagactgattgttccatctatattaccaccgtaagccagcacttctgcgtgaatcatcccatcctggccatttacccactgttcagatatggatgtgcccctcaatccataagcctgtccattcgtcgtcgtgaccgagatatcaatgtcaccattattttccattccggccccataaatgaccatcccatatgcgtttgcccattctcctgaatccaggcttccattatcaatgattatttttatactaccttcattgtcaaaggatgtttttgctggtacatcatatgtcccgcatcgtattccaaatatcgtcccaacgagactcctgtcttgtgcccctaatatatcaatcccaatgtcagcatagttttggaagccatcggcagaatctattccgccaaggttcttacctgtccctaaatccccatcctgctccaatgaaatggtaagcgaaccggatgtgtccgtaccatttgcaacagaaatacctccacctggattactgactgcaaagtatgattggtcggcatggttttccacatggatgaggttttctccctctaccacaatcatcagatccttacggttagacgatatgacagcatcatctccggatttcccatcaaccgtcctacttaattgaacatttgataattccagtttcccctgctctgcatcccaatggatgtcatgctcaccttgagttccataaacaaccttattatcgtcatccaccctcgcatactgatacacatcatccatcaacaggcccgcgaccataatttggtcttcgggattggtcataaggttggttccgccgaactgtacctttatctgcagtggctttacaccatcctttaccgtatatccttccggaagcagtgccttaaagataaattccccttcatatcccccatcctcaggatagtcactgcattcccatccttcaattcctatttccgattttaagtcctctgatacgtctccatccgcatatattacagttgcactgattttttccggcagcatggatactatgatttcatggcctaccctgttaatttcactggcacccggcagggaaaggatattgcctgagagcagttcctgctcatccatccatttccagtcggtaaccatatcaccatcagcaccaggtaagacttccaccactattcttggcagctccgccgaagccagctgatatgtatcacgcaccaatacagcatcgaatacatagatacccgggacctccccatcatactcgtccctatcgctaaagccttcatccagttcccacttgacacggatatttttccactccccatcctcagttttcgttgccgtactggatgttgccacggtcacatcttcatcctcttttttgattgcctctgaaggggatgctgtataccccttatcctcttcatggtccttggttgcctctgacgaggatgcgatatgctttttagcttcagatggagttgcagtatcttcatcatcaaaggattcaatcactacaaaaccacgcagcctttccggtaagtccaggtttttcttttttgttccgttagggacctgttgatacagtatttcctctggcagttcctcaaactcctctatctgctttgagacatcctgctctgcaccatagggcattatacttcctatattactgcatactaaaatgattcccaataccaacagcagttttctgcgtctttttgcccccccccacccggttgcctgacgatgtttcttccgcatacacagtcatccccatttgtcctgccagcagggcggcacacagtagcagcgaaaagttacgtacatgtttcttatttttcattctttcccctccttaaattttgacaatattgctacatctatgcttaatacacctcctctcccaagatgaacaaatccgttcatcttccctaaaacgacgaaatgcgaacggccatagccattcgcaatttcttatttaattatatcaagttctggtgtggatgtcaaaactaatttggggaatgacatcaaagtcacctcataatgcaaaggctggatatgtggcaacccatttaagacatccttctttgttgaccatcctgctactgtttcccctataggatatcatagaaataaagaaagatatttacagccgcaattgtaatcataatcaggcctgtcaaaatccaccagccatatttaatatttttatcctcattcgggcaataaaactcccttccatcccttggattataaaatatttctacggaatcccctggatttcctgccttgaaacatgcgattggcatccttgcgtcaatcccaaggtaatccttatctttcgcattatatctatatattgtatggcagacaagagtaaatgaaggccaataattcatctttaatccccggcggcttattttcattccgttaaaaaatccactgcgctccgtgtggtcaatcactccgcttgttattgccgtgcatctttccttaatattcctttccgcctttctttgacgggtattaaggtatacggcaatcacaagcactatcacactcagtatgacgcattcttcaaaaccacttaaggctataaccattggaatcacctgatttcattctgatattttcgaaacacgtctttacatatctttacggaaatataatccgtttatatcgactacggatttgacgtcatccatcatccctgtatcccttccgcgtatatccgcctaaataccattccataaacagattaatatcttccagcacatccataatcctccatctgtattcctcattttccttcagttcctttaacaaatagggcttcacgatacgtttctccatgatatcctccctcctatctgtaaccattttcctccaacgtcatatagtatagaaaatgcatccgggagggaccaatatgcctggaagctgggaatatcagccatacctgacaacctatgagtcatttatattctataatgccattggaaaccacgatgactatttctatcatcccatagcagtggctaagcagattgtcaatgggactaattacaggttcatgaccattgccgagccaaaagaatccggccttttaccacattttgcaattgttgacatctacaagccaataagcggtgaggcatatgcaacaaaaatcacacctttgtaatgcatatcccggacaggacagacctggactttcttcatttccgccccaggccggcaggccggctatttgtcatgcccatgttcaatcttattcattatcttatccagttcatccggttcaggctgtgggacctcgctttcatccacagccttctgcgcccagcacacttcctttaaaagctggtcatctttgtattccttcagaatattcttattaagcctgtcatcgccctccattacattccctccttcacattaccatacataaaaagattctctattacgaaacattatacttatataaaagtttagaatcaagataaaaatttcgctatagcgaatcttccaggaggccgtaacatgcagaaattaagaccggacatgaacattggacagaatatccaggtattacgccaccacaaaaagctgacacaggatgcaactgttgcaaaattaaatcttatgggcattgaaataacaaaaagtacttacgcaaagctggagacaaaccggatgaatgtgaaagtcagcgagctgattgccttgtccatcatcttctcatgcagcatggaggatttctttgccggactaaaaaatgaatttataaaatacatgcaccgcgaaatgacataaatgcacgatatccggcatgatatcggcatgatatcggcgcacaatctttatattgagatattccgggtaaaatgataaagtaagtatatggatagtgactgattcagaaaagcggagggcctgctgtgaaatttattgttaaatgtcttgtaatcatattaatcatcgtccttgccatgggtttatatgacacaatccgtaatggcctgttaaacggcgacggctaccgccctgttacggaacagatgaaggaagtcatcggcaattgaaggcattgtcccggcttcacaaacttcttacaaactgttcatattttgtccatgctttgtctattgaatgctcatatttgctgaatatactatatcttgtaaacaaacaatgcttataagatttttttcataatactcagccggcagaaggaattctgaccggctcctcccttttttagggggaatacctgattgccgctggccagacataagaaaagaggagatagaagaatggtaaaatgtaataacctttacaacaatggcaacatgaaaatgatagatgaacgggactgtatcaaagtgtttgagcatcagcgtgatttaagcgttaacccaggctctgccatggctgcttactatgcagcggaaatgaacgtgcgcagacgccaggtactgattgaattaaacggaaatgcgtttacggttcaggcaggtgcaatgcagtggattgcaggagccgttaaaatgacatccggcatcaagggagtaggcgacttcctgggaaaagccattgcttccaaggtaacgaaggaaagttctgccaagccggaatactctgggaatggtctggtcatgctggagcctacttataagcatatcctgctggaggatgtagctgagtggggaagcctggttttagaagacgggctcttccttgcatgtgattccaatataactcagaaagtggttgccaggaccaccctctcctctgcagttgcaggcaaagaaggactttttaatctctgccttaccggcagcggcattgctgtactggaaagcccggtcccccgggatgagttgattgagttcaacctgcaggacgatgaagtgaagattgacggcaatatggctatcgcatggtccaactccctgaaattcacggttgagcgttcttcaaagtccctggtaggctccgctgtgtccggcgaaggcctggtcaatgtctaccgtggcagcggacggattctgatggctccaacagaataaaatcccacgacagcctggatggtttgaattctctatttgatgggcttaattgggtatattatttgaaaattttaaaaattttaaaaattacacttttttatcttgccatcttccggtctgctatgctataatcgccctatggagacatagctcagctgggagagcatctgcttgacgtgtagagggtcgcaggttcgagtcctgttgtctccagtggttgaagagtgctggaatccttgattttacaaggttttcggcactttttccgttttatgcgacctggatttttgaaggcaattgaagacaattcttgtttgtcgttaatatagggttgttcttgattttttcttatgtttcatcttccctaaacggactataaatatatttatgtgtcgtttctaaatccgtatgccccagccaatgtcttatttgaacaggggtgcggacgtttttctggactttctgggattccgaaaggaactaaatcagtttgtattcaagaaataagattaacatcgcattgcagatttataatcagtcgggggaagtgacggagacaatcagtgttttaggttatcccacgtgaagggccttatatacttggattcgtaatgatggggccaaaaatcccccagcatcggtcagaccgccctgaaaaatagagggaacgacacaatcgtattggctcagatacggctctaagagtccttcaatttccagtatactgtttgaatcaacgccccactgttctaataactgtggggcgtaatttaaaacaattattcgaagttcgcggtagtactaagttgtgtcacagtattataaattcgttaaaataatactaattgaggctaaaagcactgctataactttcccaccttttatcggctctgcaaacagcaatgtactgagtacattccccatcaatagtgttcctgatgcaaacacaggtattacaacagaagccgcaattaactccaagctttttagctgtaaggctgtattgaggatatttgatatcccaaacagcaatcctattgccaatggcatcccggaaaaatgtggatgccagctaccgtttctatattgtatccaattaatgagcaggcagaataaaaaagctataaaatatgatactgttaaaaagactatcttatattcaggaagtgcataataagcatatattcagtaccataaaagtgtagttgttatcatctaaaacagtgcttgctgcatatgtaacattcggatccgccattttactttttacaattttagactattaggatacattccaggaacatacaaaattcacactatttgcgattatagtctttccgtctttagagatatccatgtttttgattccggttaacttttcatgacataatgtttttaggaactttcctgttgctatatcccatagatgaatagagttattttcttcagaaattaacatctctccgttagaagacactgcaaaaaggctaccatgtatatcccgcaaatgtatgtcatgttctaaatcccaaatctgcgctaaggattcctctgtaacaagaactccaattttaccatcatcagatagcaataccttccccttcgtaaagtaactgcttttagaatctttttttacagtatatcggctgccttttttagtgtcagcaaaggtacagatatattcttcattattactgctggtgcgcatctccagttttgataatccgtcttttgacatcgctacgctttttattctgggatgcatcatatgggactcttttccaaatggtgttttcaatttacattccgtaaatccaaaatagtaaatttgattgtatgatatgatatatactcctttacaatcggatgtaaccaaatatgatattatagtctcatccctaaccggaaaacgtattttcttttcaccttctgctattctttgaaatttgcccaaactatccctttggtatattcttataatcaatatatcattaccttttcccaataaagcagcaatttctcctggtattttttttgaaaggatgaccagacgattcttttgtgttgtaaaaactccaataacatcctccttgcttttaaaagtcacctgaggattcacaatatcatatacactcaatatgcccatattcttttctggataagcatactgcctgatttcatacacggttccccaatttgtatatccaaatatccaacctgaatcatctaactctaccttatctaaatattcgtattcatattctggcggcattgctgaaaaatgctcaagacgggcgtaaggtccctcatcaattatctctgtgctttcggcctgaccttgaaaaacacagattttcctcaatttaagcttcccggccacagctgtgcatgttccctcataccatagttttgacgtatgcgcaagttcaggaattatcagtgataatgacagcgggctgtacacaagtcccaatgatacagtctcctgagggctaggcaggcagatgacccgctttttatcagactgtactctgtttaaaagtggatggttcaatccttcctgggttccatccaggatatctttggcaaaataccagttactatgccctcctgtaagtatcacaaaatccaggtagttttcggataacccctcgtcctccctctgcgctgcctgcaatccgccttccagaagctgcctgaaatctaaaatgtgtcctgaaatcatctgctcaaacttgaaacggtcaaagcctggaaagggggccccgccgaatatcatggaaaacgcagcaacatatccgcaggttgtgactgtttttccttcattcaagtcacgtgaaaccgtctcctccttccacctctttgctgcggagtttgctgatgctatctgctccgcctgttcaggcgaaagggactgaccattacttttcattcctttcagatagtctgccacatacttctccaggactttgtcaatctcacggcctccacaggccagccggctccccttcacaggccaagttactatgatttcattggagatatcctcagcgtgaaggattcccatagttttttttgccacatggtaccggctaaaagccaaatccgtagttcctgcccccatatctatcaaaagcagataacctgtctggccgctctttaaaatccctttttttcccaactccccagactgttgactaagcactgtatacaaggctgctgatgcctcattcatggaagtgacattctgaaatcctgcctttatggctgcctgtttcataaagttacgcgtctcgtccttccatttgaccggataactgatgatggtctgctccacatcctctgcggcgccaagggtgctggactgctgcacataccatgtatacaaatacgacaaaaaactttctgtcaactgctctgcctgttctttctttaccggattttcgctttccagcttcatcttaaaatctttaaatatttcggccccctccactggttcatccgcatcccgcccacaggtcacggttccgtccgcatttctacgcacaattgtggcagctttcgtatccgcttctccattcccaaaagtgactccttttgtgaaaaaccggtcgcccaaaggttctccattctgatatcgcttcactttgattaacgatgtactggttccaaaatcaatacctacaacccgtgtgatttcagtttttcccatatgactgccgtcctttcatctatattcttacaaaccgcggtgcctgaaaaatcgcatttatattattccacacgctcccaaatatgactaagattatactatatttggaatgattcctcaatgtatacccacacataatatcctaaaccttaccagtaattaaagcaagataagttaacataaaaaggcatagcaggaattgaccgaaaaactaaggactaggccatatagcccagtccccatccattttccgcctaaataccttatttgaaaccataataccaggttccatcactgcaataatttatccataatccattcacgtacggttcatatgtagacggcttataaaaccatcccccatctttcaatgcagccggagccgctgttttatcaggacaccagtcagcttccataaaaccgtccgcgagattattggactggattccatgccccgccagaactcccctgatccatgtccctgtgattatgtgaatgtccccatcttcgttatctggaccaaaatcataaaacaatatcccatctccattacggattccatcctggaaattcccaagataaatacagtcatcccgcagggatatcattaagccgtatccacttgccacaccatctctagtctctccacagtaagccccctgcaactcaccccgcgacatataattaatcacgtctggtccgtcccctgctttctttccttccttatccatcaattcataatatcgtccacctgaactttcctgaaaatgtaccccctctttcatgataccattttcaaaacgtccggcaaaaaccagtttatccttttccttatataagccataaccgctgcggatacccttttcaaattctccgaaaaaaaatgagtcccccttcatttccccaccatatccttccagatatccattcatccgcttaccgtaataagaaaccccattttcttcccacctttggaatgttttaatatctgcaggcaattcttccctgtggtagcaatccattcccaccggatttttcctcatcagactttgtggattcggattccatacggtggtaaagggaaccaaaaacaaaaatagtaataataatataatttgccaattcgtttttcccgtatccttctgcactttttcagtttcttccacttttttcacatccataatctccggcagacgatacaatatacatactaagggaatcaattccacaccgcctccaagaaaaggaaatactgttccaagtccagcattgctatcaatcataaacagttcccgggcaatccccatgacagcaatcaaccataattccaaacggatatagcgggcaatacgccatgtccttttcctgtgataagggatattcgctgcggcaatcatcatacttataaaaagaaataagattactccaactgcgaatttgccatatgcaacatgaatgcatgtaagcggtttccacttccaggtaaaaatcataaggttatcttttacataatgtgtaaccggattaatgacccactcatcaatagcgccaatattacggttccagtttataagcaatgcatccatacgataattcagccatccaacatcccgtatggtgccttccgggtccaacagatgacagccaaggctgtagatgatttcccggaccctgccgtccctgtaaaacagcagcaaggccaggcagccgtataagactgttcctatgccaataccaagcaatttccctttggtgcctttcatgtctgttacgcattccccatagaatacaatcaccgcaaccgcagaaaatatgaatatttccatgaacagtccctcaaacgtatgtacactggccagctgcagcatatcatccaggattaggattccataaaaggataagaggacataaagggtacttccggtcaatatatggaaaaaaccacctctcctgatttgttttcccgatacactggcagcttttatcattgcaaacacccaaaagctgctgagaatcgatttaatggaatatacgctaaaaccaaatgggggcaatttgtgattatgtaacagagtccaccagtttcttccaaataggtacagaaatataagaggtataatcagataaatgatactctttttcctctgcccagagatgaaacacttaattcctgtaatcaatccgcagcttccaatcaaggatccaagtgctgcagtcatataaatcaatgcatcaaccctttccccctgtgaccactgatagaccagctgtaacaatgtaaacaggataagcataccggctgctgataagatgcttattttttcaaccaacggataactgttccatctcaacttccacttcgttctgtaatttgtatacagcatgattttgccccgcttttacattaaattgatagtatccccttgcctgcttttttcctgaatacagtccaaccgttgttatttccaaatcactttcagaaattcgtagcagaaccccactgccttccgtccacatggacggtacatacacttcccctgtatgcattgtggttttacggatgcttccaacattcagatacagattctccctaaattcatcccattccacacagccagaaagattattcaaagaaaaatgtgtatgaccagagataaaaataatattacgatgggtatccagaatatgctgcagcctgtcatccctgctcagataaggcgcgtcttttcctggtttcctctgtggattatgattaagaagcggggcatgacaaaggatgatatgccacttcaaaccctttgtctcatccagatggtttgaaagccattccagctgcctgccctcatggaatacaaaacggcgaaaatgtgatacacattgaataccgatgatttccatatgctcttccattggcacggcataggcgccgctgacatcctgattccagacaatgcccacagattcattccgttccttcatccatttttgaaacattggatatccgccctgtccctgctttccaatagaaggggttggtttcagcgggatatcgtgattgcccgcaactgtgtaaatagggaggaaaataccgtatcttctccaattttccatcacgcaacttttcaagaactcaaactgctgttcacttccatcattcactgtatctcccgccaaaagaagtccgtctgatcctgttgcaaaatcatacagcttctcaaaaggcgttgctttattggatatatgcaggtcactggcaaccgcgaaacagtaactcttagcagaagtttttcttatctctcccggtatgaattgcagacactcccttatctggctgcagtcctctgagaccgcacggcagaggaccgatacagcagtctccgggattgccctcttgcccgaaaagtcaaaactcccactgcccgatatcagcggaacatatgcaaacggtgtccagtccggcaatgcatgtccctctttatctgcccagaaaagtactgccatcatgaaacctggtgcaataatccgatatcccccatccgcaccatctggatttttaagcttaatcatcaaacggagttcattcattttacaaatcctttcctactatttgcgcctaacatccgaaaaatcataataaatggatgggagtatccattcccgttcagttaccggcttccctgctgtcatagtaaaatttaaagtcattctttaataattgggttccctttttttcaactgttatcagatacaccataccatccggaaaagtccgggtcttctccatccatttcatatcgtactcaagaatcaactttaccatacacataagattactaggtgttgcaatcacaaataaatgctcgtaatccttccaaagcagatcttccggaaacaaaagactctgataacatggaatattacgttttgtaagacccagtactgcgtctaaaagctgaaatgcttcctgattcaaatgtgaattcttcatccatactgcggctttatcagaaagatccccaaatgcaattcgcttaatataggtatccagtttctgtgcttcctgttttatgtatgcaggatgattactaagaaaataaatattcatgttttccccttccatatatttcctttaaatatccgtaaaatatgtgcatccaactacttgaatcaaaaccgctccaacctgccgcgcacttctttgatataccgcttgcttaccggaatctggcttccatccagcagcaggagcatattccggttcttatcaaaagcaagaaccttggacatatttacaaggaaactctgatgtacccgcaaaaaaagatccgtgtctttttccaatctcatctgtgccgcatccagctttcccggaacttcataaatctggcccgataccatggcaagaagcagaatggtccgctgactctggatataaaaaagcatgtcatagggaattacgtaggcaaactgcttactgtcccacttaaaacactggcgctgtgcctccacagcagcacacatatcctcaatctgctttttccaaatcaggatacgctcctgtacgctttccacatgacgcatcaccgccacaggacgggccgcaaaatagggttgcagattaaccgcagttcttccataaaacacaatctggcaatagacattgctgtttaatatccactttccggtacggacagcagccatggtatggtttcccacatgaagaaaagccatatgcgcctctttcccgtgacgtcccacaacttcttcagtttcaactgaaatccagtccacctggaattcacagtccatcttccaagccatctctgacagaagctgtctcagccacatctgcctttcttcgtccccgtcacataccatgattgtaaactgtttcatccccatcagtcttttatccccgtaagcttgcaatatgtttcgtactgttccgccagtaaaagttcctttaacgccctatgatactgccttatcccatctctcagcctctgagtcctcccctcccccgccggttccccagcctccttaatcacataagccaaggcttcctcatgcagctttgccgccttttggtatctgtttttttcctcctggctctttgaagtaagcaactgcggcgtatgataatccttatcacaaaacccgggatggtacatcaggttctggacacggaccagccttccctggggatacaacacaacggcctcatactgaggtttccagatttccagtccattctccttaatccgcatacgatgataaagaaaatgtacacacagttcaccatttattaaagaaaacgcaggatacagcattccctgttccaaaggaatcattttccccaaaatatcatttccctgcacattaaccataaattgtttccattccatatgttcctccttaatcacggtgcgcaatcagcagatagttaagacccgtagaccatgcgtctttaaaattatcataagaaacttccttcagacagccatccgctatccccgggtcattgataatgaccttctgattcacctcgtccacggttacaatttcaatggcgtgattagatgaaaaaaatgggtagtagtcgcaatattcggtgttaagtgcacaatcgttcaccgtaacaatcatccgctcgtcctgtcgggatgcctgtaaaatatcatcgaaagaggccgccattttctccgtcgtacgcactccatacagttccagaagatttcctatatcctctttcagggtaccctcacccggcacataccagccatgattcatggctgcaaatctcatttcatcctctgtttccataactttcgtatactcattaagaatgaactgctgggaaacaaccgcacaggtatcatcatacttctgcatatgccattcctttgcggcctcgtccgcatcatgtatgccaatctgctctctttcccgctcctgtatcatcttttccagcaagggggaccggattgtttcccggagcgtgccgtcctccatcctttccctggaaatatggacaccgctgttttcctgcccttcccgttctgattcctgcaggttttccttcatctttttccattcttctgaatcctgttctccggactcaggtttctcctcaagattattaaggatgctttcccactctaaatccgtctcctttgcaggattcgtgaggtcaacaatctcttccggttcaaaatactcaaattcagaactcatacttccatctcctttggcataagcattccctgctccacaagctttccgtcatggtaccatgccggtttgaatactgtacacacagtcccgtctaccgggacagaggatgccagatacagataatccctcagcacccgtgcacttgtctttagttcctgctcctgtgaacggtaaatacctgctttcccaatcagttccagcaaatgctttgccgttacttgatacgttgctatgcccgcattttcccctatatccagttcgcttaaaaaagcggtccgaaacctatcctgactttccagatgtctgacccttccgcaccactccagatacccgtcccggttatccagttccggttttaatacagactgatacagactctcatacagaccatcaaaaatccctgcattttctgctattccgcaaaccagcagcttctccagttcctgtcggcgtaaggcagtccgtttcatttttctaagtttacagattgctgctcctgccgcaattaccgctgccatcataacaaacgaggccgccgcccttattatactacttcccattttccctcttttctgctaattgctagagactcaagtgaacccaggccgccgcatcatccttatcgccatagacaatggcatgaccaaccggaagagctgggattaatgctttctgctcctccctaagagccagactggatgccatggcctggcagtcatcaggagctgtcatacggtggacgattttatagttggtattcttaattgcatccggaatcagacggctgggtacctggtccacaatcatcagcccttccccatagctgcgtatttccgacagcatattgctgaacagattggctaccacctgctggggattgccagtaccgccagcatctgattccggcttcatcagcacattatgcgcctcctccaccagtgtcaggtgtaaaagttcgttcctgtcagcgcgggaacggtattctgcgctgttctcatagatggatttacggtattcatacagactcaacatcaacagggacataatcaatgccttatcctttgcggaagaaataccgcttatattgattattgtgggatggctgaacaggctgtcataatcagtggaacgacccacagccaacaggcgtcctctggttcccctgtttaaatactggaaacgcgtttccagacaggccatcagattatccttcactttttgctcataatgtttcttatccattactactcttgccatcttcgtcaaaaaatccagtgtcggatatttttcctgctgtttcataggaaaaccatttacaaattcctccccgtaaaaaccgcgatagagattgtaaaccgtttcatccataagaaccggaaggatatcgctggtgggaagactggcgtttaatagcgcaatcagattttcacagcgggccgtcatgtcaacctttgctccggaaactgctgccggctcaaaaggattcaactggagcttttgcaacaattctccgttaaactccatatgtcccggcataaatatctgaaactgcatatcttctggcagctgtttgttcatctccatagcccaacggacataatcatctttagccggttcaataatcagcaccggcactttcttttgcagcagttcttttaatatcttctttccactagtactctttccagaaccagtgcttcccgtaataagtgcatgccttaccaggacatcaggttcaatccggtattcatttttctgctccactcccatatccactatcttaccgagacatatggtatccccctctgtcacaggcgggttattggcaaagcggacagctgtcttaacaaaacgcagtcccggaacgtcacgccttggcaaagaagtagtcagggccagttctttggtgttcataggagtactcagatattgataattgcgtccgaatacatgccattccacctcctccgacattccatctgcatttgcattgtaaaggggaatcatgttaaaaccgccccggacaatatctatggctcctgatttttcattcagcacatgaaggcggataggttcaagataactctcccttccagaatagatggcgcgcaacataccattaaccgtagtcacatccttgcggttctttcccaggacgtagactcctacattccaatatcccagatttcgtccctgcttcatccgttcgatatgtttttccgtcaactcttcggcatattgggcgtatttatccagataagaagtgtcaacagaaagggagaagctgctgttttccgttttgcttaactgtccaagtcctacacccaaggcagttcctaacagtctgcctgcactgctgcccaaagtctggccgattacagttccgacgcccggtgcaatcactgtacccacacccgcgcctaaggcacctataatctgtcccaagccagaaccggccattttccccacatctgctgccgcataaggatttaatcccttctgacttgatacactgttactctcatttatgctgatgcgccgttccacatcggaatggatttcgcttcctatggaacgcattttattgataatctcattggtaccggcatcagatataggatctgcaatgaccaacagggagtaggggcgatcctcactctgggttccccggatgccaaaggccagggaatccaacgtctgcaacacacctggttccttctcggaaaaaaatgatggcaggcctgtcactgcaccaatacagccatagccctgcaggggaaaattgatttccatagccgcctccatgtctgtcagcgaccgcagctctactcccggcatactgccggaactggcttccttcacctgttcaatggcatctgaggcaataaagttggggttggacgacattgctcccagataaagatgggtctttccctcccgtctctgcaacaggaagaggaaacgatatccccatgcatgcagcgaggaaagtaccccctgccagcggttgaataaatcatagctatctgagttatcgggatggaccggcagacgtataacctggagccaagtggctttgaacggctgcgccgatccatcattctggggaaatatcttacgattactgatataatccagataactacgctccatggagcagtcaagcagttcccggtaaaagttatttggaacctggattggattgtcgattactaatgtgttagggtctattccatgaaacaggtcctgaaagcggatggacggcctcttttttgaattgctgacttccatatgtattctccttatttatttcttcttatgaatttattatagcattctgtttttgtaaatttggatataatatacatttcgcctgtgaaaccgtatttttgtcattttccattgctttataatgaaaatcaacacagcttaaccgaggtaacctcaggtgtatccagataaccgtaatcttttatttttcctcgccaattaacctgagctccccaagtcgtatgaataacccgcccattcaaccgtactgcagctgtccgtcttccatctgcaatgacatccaaaaatttccctctgccgtaacataacgcagcaactccaaaattatatatcggataatatataaatggccggttatcacaatcgcataccaccatctctcctttctttgtcaatccaaccaaatggctatcccctatcgaaatagaaataattttcttccagtttcctgcctctgcaagcatggcactggtcatgacggttccgtcttttttaaggcctgcatacaaagcttcgtcgtctggactcataacaaactgttccaacccataccaactccactcatgctccttaacatttccatataaatgctggtcctctgcaacagaaccattaaacttccagagacttccatctgccctaaaaaagcatatacactcccctgtgcctgtcatgtacacaatatcattaaacggcgtcagatttcgtcctgtctcactgccatccaattccacaatccttccatcatatgtcagccctattaaatacatcagctgcggaaaaccatgacgcagaaaatccacgaaacggccagttactttctttgctgcaataacagtctcttgtattctatttttatttagatttgtatggaatgagggataacccctcttgtctattgctacaaatatttgaaatacctccaagtgaaacacctcaaggtaactcactgcaatgagtttatcaatttcttttagattggagaaaaacacatcctgagccgagcaatatacggttccatcgggtctgactatagcaatatcctccccgccaaccaataaaacattttgtgaccaattcttataatattttcgcggaaacaccaacggtgtaggacgcaacggggaaggcactggtatatgcagattattcagttctgtttccaattctatcttattccctatccctgtctctgtctctgtctttttcttcgtctccatcttaaaaggaaggaggctgtacacaagtcccaatgaaactgtttcctgcggattcggcaaacagatgatgcgttgcttctcagactgaactctgcttagaagtggatggttcaatcctcccctgcttccgtccagcatatccttggcaaaataccagttactgtgccctcctgtgagtatcacaaaatccaggtggttttcggataatcccttgtcttccctctgcgccgcctgcaatccgccttccagaagctgtctgaaatctaaaatgtgtcctgaaatcatctgctcaaacttgaaacggtcaaagcctggaaaggaggccccgccgaatatcatggaaaacgcagcaacatatccgcaggttgtcactgtttttccttcattcaagtcacgtgataccgtctcctccttccacttctttgctgcggagtttgctgatgctatctgctccgcctgttcaggcgaaagggactgaccattgcttttcattcctttcagatagtctgccacatacttctccaggactttgtcaatctcccggcctccgcaggccagccggctccccttcacaggccaagttgctatgatttcattggagatatcctcagcgtgaaggattcccatagggttttctgccacatggaaccggctaaaagccaaatccgtagtccctgcccccatatctatcaaaagcagataacctgtctgaccgctctttatcatccctttttttcctaactcacctgactgttgactaagcactgtatacaaggctgctaatgcctcattcctggaagtgacattctgaaatcctgcttttatggctgcctgttccataaagacacgcgtctcgtccttccatttgaccggataactgatgatggtctgttccacatcctctgcagagccaaaggtgctggactgctgcacataccatgtatacaaatacgacaaaaaacgttctgtcaactgctctgcctgttctttctctaccggattttcacattccagcttcatcttaaaatctttaaatatttcagccccctccattggttcatctgcatcccgcccgcaggtcagtgtcccatctgcatttctgcgcacgattgttacagccttggtatctgcctctccgttcccaaaagtaactccgtttgtgaaaaaccggtcccctatgggttctccactcttatatcttttcactttaatcaatgatgtactggtcccaaaatcaataccaacaactcgtatgattttattttttcccttctcttccatatagttgcaccccattatattttagcctgaaaaaccacatttttgttgttctgcctatcctcaaatctgattacgattatactataattagaatgatttctcaatattgcaaatctttgcacaggtattttcatatcagatgctattataatttaatgtgcatcattagacgaatattttttaaaatatcacatcattccataaaaacaaaataaaaatccagacaggtgtcaaaagatacaccctctggatttcccccaccgcctatatgagcagaccggacacctcccccacgtaaaagagtgtcagccggtgcatggctcttgtgcaggcaatatagagcaggctgcggtcataatcatctgaataggtccctctgtccgcctgcggaacgatgacctcgtcaaattccagtccctttgccatctgaatggaggtgactgatacgcctccctcatagtgcgtgctgtccggcgatatcagttttatacggtccccgccggattgtaaaccacaggaaagcaggtcatggaattcccttgcagccctgttgtttttcaggatgatgcccagtgaagcgttttccccggcttcaaattccaggattgcctgctttatctgccggatttcatcctgttcatcctcacaggctaccatggacggttcctccccatggcgttccaccgcgtcaagccctgcaacatcccggatgtgtttagcgaaattcatgatttcaaaggtagaacggtaacttctgttcagttccacataatcagcgccttcgtaaatcctaaggatatcctccagggtgtgcggatgatatggattcaggttctgtccaaaatcacccagtatggttttctggcatgggaacagccggttcatcacggcatactggatgggcgtatagtcctgcatctcgtcaataaccaggtgctttgtaatgacgctctcctttacgccctcaaaggccgcttggagatataaaaatggaaacacgtcaggccattccaaagtttttctggcaggcatcacgaacagatggggttttccaatggattgatagaagtttttgtacagggccagtgtactcttaacagccagcatggaggccaggctttttgcaatccttcccgggcctggcagttcatcctcccatatattttcattcttgaaccggttatggatatcctctgctgtcatggaaatcctctgcctgacaggatatttcccataagcacggaaacggtcccgtatccatcgggcatctgccgtaaaaccgccaaagcagtaatcctctggcacaaaaatccaatcctccatgccacttatgtacgcatccatctgccccacaaaatccagcgtggatttaaagcgtacccgttccatccattttccatcctccatttccagagggtccttgtccggttcgaaattgattatcttctccagctgtatttccgcaatatccaaaaagcccatttcatagacaggttcctcccccagttccggtatcacgttggatatatagctgccaaagactttgttgggggacaggattgtcacgttccgggcgcttagctggttcctgaaccggtagagcaggaatgcaatccggtgcagggcgattgaggtcttgccggaaccggccacaccctgtatgatcatggtcccggtcttctcccttcgtatgatctggttctgttctttttggatggttgatatgatggacttcatcttttcatccgaagtatgggacaattccctctgcaggatatcatcctgcacatgggcagaactctcaatggcatattccatgacgccgtttctgatcttgaactgccgtttcctggtcagttcaccctcaatccgtcccatgggggcatcatatcccgccgggccaacctcataatcatagaacatactggcaaccggcgcacgccagtcaaaaatcaaaggctcatttccataattaaatgcagatggccctatgtaaaacctggcaggcgccgcgctgtccccgcccttaaaatcaatccggccaaaatagggggattccctgagcctagcaagcctgtcacgtatgtccacggcaaatgcgccggtctggtctgtctgtttgagaagcagttcattctgaaacatttcatgagggtcaatctcacccctgttttccgccatgtagcgtttctcatcccggtactccctgtctatgcgtcttacatcgtcccgggctttttccagcgcttcatccagcttgtggctgatttcagaaagataggcggcttcttcaggaaatataatacccttttctgttatctggtcattactcattgtcatcctccttccggactaccattatacaaagatccggaagacggcgtttaatcattcttgctgttttatgccagggttcccaatgcggatttcttcccagtgcggacatcctacactcccaaaacatgggaacttcaaatagatggaatctttatgccagttcccatgctttccaatggaatctttattccgtttggcattatcataatatcagccaaagagatgaaaggaggcgaatccactatgaaaaaacagacaagagaggatttaatgggattggcgttcatgttccttctgttgatgactgcagtaggtgtaagggcctatatctggctctgacagcagccgtgaccacatataaaaagtaacggtcctgatgcaccatcacatcagggccgttaccttctgcactcttcctcaatccgttttataatcatctcaaactcgtccggggctggctgtggtacgtcttcatcccttacatgttcttctgcccactggaattcctttaacagttcttcctcctgcccaatctctttccacttcatatccgccgcctccttctactattattgtaaaacacaggcggctatatagatagagcaaacttattacatttgttgaaatatttcctaaaatgaaacgaaagactttttcataatttgttcctttcacccgcggcttctgctgcaaaatcccggaatccgcctcagtttcccggctgtccaggcaaacatgccctgaggcagttcaaacacagccacaatccccagcacgatggcaaccgctgccttgacagccgcatacccggtatgcacggccagccccagctggtccgtgacaagataatatacggtccagtaaatcccggctccgggcaccagggggaatataccggatatcaggaaaatagtaaccggacagcggtttatgacagcggatgcccgggacaggaaaatgaccactaccgtggcagcaaaggaagagcctacaatcccccaccggccggacgccagcacatatacggcccatcccgcgcccccaatcacaccgcaccatggatagtatttcctcggaaccccgaataacagggaaaaagcaatggtcccgatcattgctgcacatacctgagatatcataacagcgcccctcctgtcatccagcccgccagtgcaaatcccacacccacgccaatggcaatgcagaaaaacaccagaagggcatccagcatccttaccgaacccgagatataatccccgtccgcaatatccctgatggaattagtaaagggaacacccggtatcagcggcatgatggaaccgatgaccatgaaattcagatgattcccgattcccgccgaatacaaaaggatgcatatggccgtgaccagggcgccgccgcttatattgcccacgattttagacaggtgcggcccgcttatatacagcacatacagatacagaaggaccccggctgtaaatgcaaccgcactgtccgctgcattacctccaaacagataacagaacgctgcgctgccgcagccggatgccagcacctgcatgtgctttgtcttaccaggcatccgtttgatatcatccagccttcctgccacctcgccgatggtgtatctgccctcttctatctccctggacagctggttcaccgccgccacacggtccaggtgggtgccgctgaccggtatatgctccacctttgcaaatacaggctcattcctattccccacggttacgaatatgccgttggtcagcacaaaggcattgccggaatgtaccccatagtactggcagatacgctccattgtctcctctaccctggatatctcagccccattttccagaagcagatggccggcctgcaacgcggcctccattacttccttttccctgctctcctccacggatgtccctcctgattacagaaaagattgattcagccccggactggccggaggcctgtatcatactgctgatatcatatcacagggaatgggttggcgccataccttgtttcatccaaactgcgcaatgcggtactaagtattggaaatttccttttcaattgtcctgggcttccccatttcatccagagccacatagacaaacaacgcctctgccacaaggaccttatccaccttttcatctcccttgacgcctctgtgctgtgaatccatgctgacatctatctttaccctcagggatgtattccccactgccgtaacagctccggccacctctatgaatgcccccactggaatgggtcttaaaaacttcatcccttccaccgccgccgtggtgacctcgggacctgcaaaccgctttgccgcgattcctgccacctcatccatccattccatcagcataccgccaaacagcacccctctgaaatttgtcatggacggcatcacggcccttgtcatgattgtcatatcagacatcattttcccacctccttcccacttcggaccttcctatgaaagtgcaaagccaaaatcataccatctatggtgttccagcatcataagttccgtgcttggggattgttcccggaccgcattccccaatgccctcagatacttatccatctgaaacacaccgtcttcaataaaaaccttctggttctcctcactcatatccttcattgcctctggaaccatcctgaaaaatccttctgtaaaatcatagtggtggggaaccacgatttttgttcccattgcctccaccagttctgcaaattccctaaaatcctgcttcggactgacatgcatcagggatatatcggagcgtattcctctgagccggttcttctggtccggcgatgtcataccggcccataccatgatccgcgttccgtcacagagggtcagacggtaattgttaagctccaggtttccataccagtccgacaggctcaggcttccgtccggattacggaatttcctgcctgcccggtaatacccccttggcgactccgtatggcggcctgcaaacacctccactttcaaatcatccatttcataaacctcgctgcttctcacccggaagatacgcgcgcagttaatatcctgccattggcacagcgggtccgcggacaaatcccccacgaaaagaatgacctccgggaacttcttctggatccttgccacatctgccgcatggtcaatatggatatgactcagaaaaaggtaatcacaccgttcaattgcctctatatccattggatggcacaccaccccgtcaacctcccctgacagaaacgggtccaggaggatgtgtttcccattggacatgacgatttcaaacccggcggtgttgatccagcggatttttcctccgttatttaatttggggacagtcccggcttccccttcattgccttgtcttgacatggtgttcatttctccttcccaaaatatactatacatccatcataatataaaatccatcccataaaaaggacgccggaacggctgtcatgccggacccagcgtccctgcttccatccttgtcagatggtgcatctgttttaccgcatgaacagcgggtacagcagaccaatccatatgaccatcaacgcccctccaatccgggtggagatggatgcaaatgccagcaggttcatacggttgccggctgtcagtaccgctatgtctccggaaccgccgatgttgcagcagcagagcccggccgtgatgcctgcctcatacggatacagtcctgccagacgcccgaagatcatggctccgataaatgccccaagcacaccaagcacaatgaccaccagcaccccaaggctgaagaacttggtcaggtcggtgatgttcagggaacagatcccgatacctgcaatcagcatgggaaggagggccttcagtgcgaagttcatggaatacacgcagttatcagcaaactcatccggaatgatgcctgtacattttacaatgattgcaaggatgatggtccatgcaagtccggctatgttgtttaataccggaaggcttcccaatacattacctgccagataaaaacacagggacatgaagatcccgcttcccagattcacataattcgcactggttgcagggcgcttcacttccttcatcgcctcctcagatgcctgggatccggccttgaggatcttgcccttgccgttccatccaggaatcttctcagtaacagcgcctccaatggcagcaaataatacggccagcacattggcaatggacgcataacagaggaactgtcctgcaagaccggtcatgtccgcgcctgcaaggctggaataaagtgccggaagcgtggtgatcgcgccgcctgaaccgccggacatacagggggcgcctacatagaacaggccgtcagccccgccgaagccggtaagcatgccgccaagcacacatgcgcccagggcaaatacctggcttcccaggatggccggcatatacctggcggttgcgcttaaaagtaccttcctgtccatgaccaggatggaaccgactaaaagcagcgcaatgtacatgtcctggaacccgcccttcatccacaccttggctccgttcaccagcacctcaggtatcaatcccagatggttcatcagggaagccccgaacagcggaagcagacaggcgccgcccagataactgctgacaatgggaatcgtattgcccagccagaagaaaatcccgccgattgccataaggaacgcccatgtctggataaaactggtcgccatataggtgcctgcatcattggaataaatctttaccgtaggcatgaacccgccgtaggtgacaaccattaccactatgaaaaatggcaggaagtattttaaattcaaaccgcacacactaaaatccacacgctttttttcgctcattgttctccctccataaagagattgtattttatctttgccataacttcaactgttactgcacatcaaatccattccataccgggattcccgtatatgcctttgcattttcctccccattcaggacgcgcagggcgcctgccgcaagggcctccatctcgaattcccctgccatcacggtaatgggcgcgataaacttaagcataccggaaagtttttccaccagatatccgtcatgggaaatacctcctgtgaaaatgatcccgtccacattcccttccagcaccgctgccatggaaccggcgtattttccaatctggtatatcatggcatcatataccagctttgcatatgtattcccctgttccatcatggcgcgcacttcccttgcgtcggaggtcccaagatggtcaaccagaccgcctgttttggtgattttttcatacagttccccctccgtatacttcccgctaaagcaggccttcaccacatccttgaccgggatggcgccgcatctggtgggtgccatggggccgtccccctgggcaatatcgttagagtccaccatcttaccctttttatgggccgtgactgatatgccccctccgatatggcagataatcaggttcatttcctcatacttctttgccaccgatgccccatagcggatgccgatttccttctggttcagggcatggatcctgctttccctgtatacccccttccatccggttaccctggccagatcactgaactcatccacatccggcggattcaccacaaacgcgctgccgccatatgtttttgaaaatgcatctgccagctgcgcacccagcatggccggatgttttaccgaaaacccggccctggcatgttccagaagcgtttcattgattgcataaaccccgccgtccacgctggccaggccgcctcccctggcggaaaaggcatccacaccttccaaagtaaccccggccttcttaagttcttccaggattgtttccttcctgtaatcaaactgggcgctgatttccttaaactgtttcagtgcccgggaatcgtgggacacattgctggaaaatacggcctccccgccttcaaacaacgcaatcttggtggatgtggatcccgggttgattgcaaatatcttatatgggttcattgtctgtctacctcctggttccccttccctatcaaagcggatataacaatggacatgtatttatcatccgcagaagcagccctggatacaagaagcacaggcaccatggcgcccagcacggttcctcccgtgcgcccgcctccgatacaggtaatggtcttggcagccacattgccgcttacgatatcaggcattaccagcagatccgcatccccggcaaccgggctttcatatcctttgataccggctgaggacgggtccatggccaaatcgtagctgatagggccttcgatgatacagccttccacaccttctgccttaatggcgtctgcctccacgctctccttcatcttagggttcaccttttccaccgcggctatgacagccaccttgggagtttccacccccaggctgtggaatgcggcaaccgcgttctgtatggctgcctttttctggtccttggtggggtaggtcagaagtcccacatccgttattccgaataccttgtggtaatggggactttccatgaaggccagcaggctcatcacatcgttcttccggattcctgtctccctgttgaccagaaccttcatcagggtgcctgtctccagcctgcccttcatgatacagtccgcttttccctcttttgcaagctctaccgccttctttgcacattccactgggtcgtccacggaaatgatcctggccagggatgcatcgtaatccaggttccttaagatatcccgtatctcatcctccctgccaatcaggatggggtttatcatgccgtcctttgccgcatggacgaccgcctccagggtatgtccatcctgggcagccaccacggcaacggtacgcttaaccggtttctccttaagcatctgttttaactgattaaaatcctttatcatccaatgcctcctgttcctctcactgtaatctgccgtacggcttcccttgggtcggtcacaactccggccagcgccgtggcagccgccacagccgggcttgacaggtagcttaaggtcttcttggttccctgtctgccgatgaagttacggtttgcagtggacaggatgcgctcatcgtcatacatcaggccgtagggcatcccgcagcacagtccgcagcacgggtggctgatgacgcatccggcttcgatgaatgtccttatgtatccggctgcgatggcatccttaaacaccttgttggtggctggtaccacaatcaccctcagattatccggcactttttttccttccatgatttccgctgcaatcctcatatcctccagggaaccattggtacagcttccgatatagacctcgtctatcttcgtgcctttgacttcactgacaggatggacattgtcaaccccctggggacaggatagctggggttccagtccgctgacatcgtagaccagcaccttttcatagacagcatcctcatccaccttcacccagtcaatctcctcaagggccatgccataatattcggctgttttttcatctgcttcgaacaggccgcattttgcacctgcttccaaggccatgttggcaaccgtgaacctggccatcatgctcatttccctggcagccggcccggtgaattccaggctcttgtactgtccgccgtccgcacgtatgtcgcccaggattttaaggattacatcctttgaaaggacgccgtccttaaggtgcccgttcagcacgatcttaatggcttccggcaccttgaaccacagttcacctgttatcagggcagccgccatctcagccgtgccgattccggaacagaagttgcccgcgcctccgtatgtggtggtgtggctgtccgttgcagtggcaatctggcccggttttgcatatctttcctcatgcatgatgctgtggcagattccctggccgatatggagtttcttaattccgtatttccctgccagggcaatgcctgcgttgtagtgggcatagtcattcttagcaaccgccgtgggcatgcagtggtcgaatatgatggtcaccttgtccggatcgtctattttccctgcccccattttctccagggtatcatagagataaggggtgtagatgtcatggatcatgaacatgtccggatgggtaatcacgatgtcacccggctgcacatggtccaggccagcattgttcttaagcagtttttccgccatggtataaccgcttttacgtttctgtgcatcatccagctccctgcggaccggcttcttaataccggcccggatcctcatcttggtgtcttctatgagacctccatgctccacgatggccagcaggttttccggtacggttcccacagggaatgcctttccgttgacccggacacattttcccacttccaccgtgaccatgtccccgccctcacagtaatcctggattccatcacactgaatcagcaggattccgctgttgaatgcattgcggaagaatatcctggcaaagcttttggcaatgatgcagcggacaccgttggaggacaggaccgttgcggcctgttccctggaggagccgcagccaaagttgcttccggccaccaggatatcacccggctgtaccgtggagccaaactcaggctttaaaagttcaaacgcgtactttttcatctcttcaatggttgggatggtgccgcgttttccgggaatgatggtatccgtatcaatgtcatccccaaatttccatatctttcctttgaattccttttccattgtccctgccctcctatgcctggccgcctgatgaatcatccatggccgcctctgtatcaaatgatgccgccatgatggtttccacggaagctgtcatcacctgggcatcctcacatcccatggcgcctgcgaatgtatatagcccggttgtgagcagcagttcttccggccccatggcgcccgcgccctggggaaccacgctgtggtcgcctgccgcactgatctgggcgccaaaatcaatgaatgctgtgatgattccctcttccatggcctttatgtaatctgcgcttgtggccgggcagaccgtaagacgaaagcccagcttcagtttccgtccctccatcatctttgctgcaatccgcaggctttccatgatcccgccattgcagccccctatctgtccggcgtggacgcggcggccttccagcgccgaagcaggctggaaccctgcctttatctgggaattcctgtcactgcacggcattctcagcatggggattacctgtcccagatcaaggacgcagtcagctgttccctcttctgtccagaacgcggtatacgcccccgtgtcacatgccatatggcacagaacggttttttcatggtccgtcaggctgccgccaatgaattcaatggccttgccctgtatatccgcctgctcctttaggaaacagagggccgcatctatgatgccgcatccctgcgcaaggcttcctatcacctgtacgcccacggtatccgggacttccacatggtattttcccgatgccagcaccctggaaagctccgtgttgctgatgccgattcccaaggcccccatggcgcctaatacagagctgtgcctggtaccggtgaccacaatctggcccggctttatctcttcctccatcagataccggagcgcggttccttttgcctggaggaaacgggtatcatattttcttgaaaatcccaggatttccccaaaaatcctggcatcctcaggcgaacccgaaggtacgttgtggtcatacatgaccagtaccttttcaggttcagccacctgggtgacgtattccgttaccccatgtgggaatccgttggtaatcagtatcatatccggggaaacggtggcgatttcgccttttgccgcccccagaagcttttctatcattctttctcccattttcctgtcacctcatatgattttatagacattccctgacagcttccccgatggcggccgtgtccgctgtctgttccccgccggaccagcacgggcgtccatgaatcccctgttccatcacaatggacaccgcccgtttcatgccttctgcttcccggacaagtccaaaggaatactcaagcatcatggccgctgccaggatcatccccacgggattggccctgcccgtacctgccagttcctcatgcacctggtgaagctggttgggacagtaaatccctttcctttccgcattcaggctgccggccggaaggaattcccctgcaccggtaagcccggcagcctcatctgcaatgatgtcgccaaacacattggatgccacgatcacatcaaacgcatcgggcgagcttaccagcttaaatgccccatgatccaccagcatgtgctctagttcaatctccgggtaatccctgtgggtttcctccagtatctggcgccacaggacgctgctggacagcaggattgccttgtccaggcttgtgaccttcctcttcctggacgcggccagctggaaggccagtctggcagaatcccgtatgagggtctcatcgtagctttccgtatcccatgcagcccttacattgcaaaggttggaggattttccctccgtggtgaacatgcctcccgcaatgtcccgtatgatcaggatatccattcctttcttgcgtatctcctccttaagcggacacagttccctgagggcttctgcaaaaaagcagggacgtatgtcgcttctcaggcagagtcctgtcctcagaagtccaaggatgctttccggcctttcctcaaacttcagtcccggatgccttcccactgcaagcttgcccataagtatgctgtctgcttccagacaggttttaaggctctcccgcggcaggggacattgtccccggtcaagggccgcggttccggctatggcttccgtgaactgaaagctgcggccgtatacttcccctgcccgtttcagggtcagcactgcctccctggtgatttcatatccaacgccgtcaccgggaataagggcaatggtataaatcctgctgccattccttaaggacacaatgtcatccatcctttcctccccggcctatttcagcgccagccccttatatgcctcataccttgatctggcctctgcctctgacttccggtaaagggcatctgcttcttcagggaaagcccgctccaatgaggaatagcgtacctcgccccttaagaactccctgtaactgccgtccggctccttgctgtctaactggaatggattcctgccctcctcagccagcgtcggattgtatctgtagaggtgccagtagccggctttgaccgcccgcttgatttcgtcctgtacctttgccatgccgcagcgcagtccatggttgatgcacggcgcgtatgcgatgatcagggacggtccgttgtagccttcagcctccttcactgcctttagcagctgggcctggtctgcccccatggcaacctgggcaacatatacatccccgtagctcatggccatcattcccaggtcttttttcttggtgcgcttgcctgccgcggcaaactgggcaacagcgccggtaggcgttgccttggatgcctggccgcctgtgttggaatacacctcggtgtcaaataccatcacattcacatccgctcccgatgccagcacatggtccaggccgccgtagccaatatcatatgcccagccgtcgcctccgaacatccagacggatttcttcaccagatgcttttcattttccagggcaaatgctgcctcctgcgccacggcgctgcctttatagctgtgaagcgccgcctttagcgcctggcttacctccttggtggcttctttatcatcaaaatgcgccagccactggaccgctgcttccttcagcctcccatcatccgacttccctgcaatttcctcaatcctcaggcacaggctgttcctctgctggtcggccccaagatagatacccatgccgaactccgcattgttctcaaacagggaaccgccaacggccgggccctgccccttcttattcgtggtgtaggggaagcttgggaagctggtcgcccatacctggctgcatcccgtggcagttgcaatatacatcctgtcgccgaataactgggttacaagtttggcataaggcgtttccccgcagcccgcacatgcgccggagaattccagcagcggctgttcaaactggcttccctttacattggcagtgccgaatggattcctgatttcaggaagcccttccgtgtaatcccagattgcagcctccttcctctcttcctccaaaggcttcatggtaagggccttttcctttgcagggcagacattggcgcagcttccgcagccagagcagtccatgacggaaacagccatgtggaacacatacccttcccctccctttccgatggcctttgctgtcttcatcccttttggggcctcctggacctcctcctcagtgagaagcagggggcggatgaccgcatgggggcatacgtaagcacactggttgcactggatgcatgtatcaggattccaggagggcaccttaaccccaatcccgcgtttctcatacttggatgttccctggggcatggtcccgtcggcatggtcctcgtagaacgcggatacgggaatggtatctcccttcatgctgttcaccggctccagtatccttgtgatgaacttaggtttccctccggtgtcctttggcctgtccggctcaagcccggaccaggcttttggcacatccaccttcacaaggtgtcccacgcccgcgtccacggcggcgtagttcatgttcaccactgcctcacccttattgccataggatttaaggatggcttccttcatatacctggacgcgtcctctgccgggatgatatttgcaattttgaaaaatgccgactggagcacggtgtttgtacggcttcccagccccagccccgcagcaatgcccacggaatcaatgatgtaaaggttaatcttcttatccgcaattgccttcctcatatacgcgggcagatggctgtccagctcctcttccttccagtcacaggcaagcagcaggttgccgccctcctttaaatccgacacaatatcatacttgtcaatgtacgcctggttatggcaggccacaaaatccgccttgttcaccagataagcgcttcggatgggcgagttgccgaaacgcagatggctcttggtgacgccccctgatttcttgccgtcatactcaaagtaggcctgtacatgcatatcggtgtggtcaccgatgatcttaatggtattcttgttggctcccacggtcccgtctgagccaagtccccagaacttacagctgaccgtgccctccgggatgatatccagctcctccccataggggatggaatggtgggtcacatcatccacaataccgatggtgtaatgattccttgggtccggggcctccatgttcccatacatggccgcaacctgtgccggggtcgtatccttgcttgccaggccgaaacggcaggcatatgccttaaccgtgcttcctgcatccaaaagcacgctgcagatttcctcaaacaacggctcgcccacagccccagcctccttatccctgtcaaggaccgtaatcctcttaacggtttccggaagttcccggaaaaaatgcttcgtactgaacgggcggaacagatggacttccaaataccccaccttcttcccctgggacctgaggtagtcaattgtctcctggatggttcctgtcacactgcccatcccgaccaggaccatctccgcgtccgggcttccgtagtaattaaacagcttataattcctgcccgtaagcccgttaatctggtccatgcaggcctccaccacatccggaagcgcctcatagtaagggttggcagcctccctctgctggaaatatgtatctgcattctgtccggtggtgcgcagtaccgggctttcaggattcagtccattatcccggaaccgtttcagttccttttgattcaccagcttcccaagctcatcataatccaggcattccaccttctggatttcatggctggtcctgaacccgtcaaaaaaatgaaggaagggcacatgccccttaatggctgccagatgggatacggcgcctaaatccatggcttcctggaccgtggagctggccatcatggcaaacccggtctggcggcacgccatcacatcggagtgctccgcgaaaattgagatggcgctggttgccacattgcggctggccacatgcaccacgcctggtttcagctgccctgcaatacggaacatggtggggatcatcagcataagcccctgggatgcggtataggaggatgccaggacgcctgcgtccagtgcgccgtgtacagcggagatggctcctgcctcagactgcatctccaccagcttcaccggtgtgccgaatatattcttcttcccatgggccgcccatgcatccacatgctctgccattggtgatgaaggtgtgataggataaatggcagccacctccgtaaatgcataggaggcatatgccgctgcttcgtttccatccatggtcttcatgattttacccataatccatttctccctttcttcagacatacggttctgtcttattgtgaattcgttgtaattaattgtaatatttaactggtttatcgtgttagtttaacgttttagcttagctttattatagttttacgttttagcaaatgtcaatacccactttttattttgtatcattcatacaatttatttcttgcttatttgtgcatattttaatttttctatgctgtgtcttcataataaatggaaattctgcggctttgtcctggtttgcctccatgtctgccccttacctctgtccggatgtcccaatccttgacaaatccccctgcactccgtatgatagagacagactgaacatacaaaaacatcttacaggaaaacattctgacagaaaggaggtgcagtccatggtgacgattaaagacgtagccagctttgcccaggtctcacccaccacggtatccctgatcatcaatggcaaggcagaggaacggcgcatctcgcccctgacctgtgagcgggtcatgcaggccatgaataccctgggctaccagcccaacctaagcgccaggcgcctgcgctccaatgaaaaactgcgccccatcattgccttttactggcccatggattaccgtaccaacatcctggcctcattcctctccagcttccagggaatcatacgcaggctgggttttgactgtgaactggtggtgcagacctatgaaaacaatgcacttgaaaaacattcagacggtatcataaagaacagctaccacgcagtcatcataggcggcgcatcctcccaggacattgcatatctggaaaccctgaaaccgcagattccccttgtgctgattaaccgtacatcggaaaagtattccacggtgtcagtggacacaagggaaatgggacttctggccgcccgcctgttccggcagaaaggatataccgaggcagcggtcctgacctccaggcagccatacctggccaccggccagcgcacccaggccttcctcaatgcatgttcccagataggaatcagcattgaggctgcccatatcatccgggtggagaataccatggaaggaggggttaagggagcggacgcatactgcagccttcctgccgccccaaaggcagtgttctgcgattcagattccatggccctgggagccctctactccttccaccggcacggactgtcactgccccgggatgtagagctgcttgccatcggcttccttgacccggaggccaccatgtactccatcccccctgtcagcgtcatatccatgcccaacagggaggttatggaaggcgccatccgcgtggtcattgatgccctgtccgtatccgccggtgaacctgtccatacgctgattgagccggaaatcgtgctgcgcgaaacattcaaggcagtataagcccccgcatacagacggatatgccgggaaatgtgaatgccatatgttttggaaaggtcattgtatccgctaatggggggtgttagcggtgagaaggcatatcttttgcgcctgtcccctgaaaaggacccggccccattagtagctgccgccaaacgttatctggatgaggatgtgcagtacgattatcctgatttgatattctttgcgggcttattgatttaccgcgcagtccgtcccacacccagatggcagaaaatcaccgacctgattcttaatatggcatgccgggaactcgataagctgcttaataaagtgatacataaaggcaatgttcctgtcatggtatgttcccagctggtataccagtgctacgctgactgcgggacagattaccggatcatcctgaaggacgggcttcttgaaaccggccttcccggcacaatccgtctggcagatatgatagatgatgcatggggagagaacctgaggtacccttccgatctattccccggtaaccttgacctggaagtcctggcccaggaattctattccgccctgaacgaacccagtgacgaccttgccctccttggttcaggagaattgaggaatacggtcaacctggccgcagacttcctggatcttgtggaacaggtcctgaagcactccggcatcgatataccggtacctgcgctgtttgtggcgcccagcgatttattgtgccatgcagtgaacctgcagcagtacgggacagctatgatatcccgtatttaagccatgcctgttatggatgtcagtctgccatgcgcccctttttaaggaccaggcagactgacacggcatatggccagtcatttcttttttatccaatacatccattccattaaaaaaaccaggatcctggttatcataaataattccaaatttcctcttgacaaaaaatattatttaatttatatttgttttaacgatttagtttaacgttttagcaaactctactaaatcgaaaggacgtgaatccgtgttttggaaaaagaaaggaacattcccctccggccactctgcctctgacttcgcaggcgccggttccccggtcaggttcaacagcgtggaattccgggatgggcagcagtccctgtttgcaacaaggatgaccactgccgacatggttccactgctcagcgccatggatcaggtgggatatgacagtatggagatgtggggcggagccacatttgatgtggcggtccgttttctaaaggaagacccttgggaccgcattcgggaatttaagaaatatgtgaaacatacaccgcttaaaatggtgctgcgcggccagaacctggtaggctataaggcttaccctgatgatattgttgagaagtttgttgaaaaagctgcggcggctggtattgacgtattcctgatatttgatgccctccaggacctgcgcaactgcgaatccgcattcagggcagttaaaaaagcaggaaagaaaatcgagggctccatccagtacaacataagccccttccacaccatagaaaaatttgtggaaaatggaaaagagcaggaaaaaatgggcgtttccctgctccacgtggaagacatggcagggcttatgaccccggccgctgcctatgacctgataaaagcattaaaagccgaactgaaggtgccgatccaccttcactgccactgtacaggcggaatggctgagatggcctattgggaagccatccgcgcaggcgtggacggtctggatgtgtgcgtctcttccatgtccatgggaccggcccatcctcccattgaaagttttgttactgcattaaagggaaccagccgcgacccccacatagatgtggcccagtttaaggccatcaatgaaggcttcctggccctgcgcaggaaatatgcccagtttgaaacaaaactgattggcgtggacgtgggatgcctggagcaccagataccgggaggaatgctgtccaatctggaaagccagctcactgccatgaagctatatgaccgtcttccccaggtcctggaagaagtaaccagggtaagggccgacatgggctatcctcccctggcgaccccatccagccagatgtgcggcgcgcaggccactaccaatgtgcttacaggaaaacgctacatgatggtcagcaatgaaatcaaggattactgccgcggaatgtacggaatgcctccaggcccggtttcaccggagctgctggaggctgcccttggcagtgaaaagccaggtacccaaaaaccggcggacatgctggcgcccggctacgaagcagcaaaagcggaagccgggccactggcccgcacagaagaggatgtacttacctatgcccttttccccgcctatgcacctgactttctcaggtccaaatataatctgtgatacataaatacataacatcaattcatcactggaggtatcaatgaaacagcagaacccagaaaaactactccgttcccaggaggttttaaaagaactgaaggaagccagaggcggctccctgttaaactcccatcaggtcatgggtaatgatcccaacctggtcaatgcattcttgcagcagtacttaaactgcaataaacgggatgttgaaatcccaagaaaataccgcgaactgattgtcatggccatcggcatggcaacagggacatccaccactaccaaggtccatgccgggcttgccctggaaaacggcgctaccgtggacgatgtatttgaggtaatccgcatcatcttctttacctgcggcgtttccaaactgctcccggcattagaatgcctggaagacttctttgaaccggtaggcctggaagattgaataaccagccggtatgatttaccggttccagaattaaagggcgggacatgaggacgtgcaatcattcgcataataaaatattttttcatgattgtgtatattctcccgcaacgtgtccataataggagtatacacgaaagagaaaataattaatacttatcctccccttttttccaggctcactgcaaggttgcggtgggcctggattttttcctttaagtacaaggaattgattccctcccctgccgccagacctgccataccgacacggtaagactgggcgattcctccgtccagcccaaataggccacacccataaaggaaaaccatctattttcaaaataattcttttacatgtatattcaagaaaaaacaggcaataatgaaaatgttaagagaattcttaatacttatcctcccctttttaagaaccctgcatccatcatgtgtgcggggtttctttattatggactgccctcatgagttccatcctccgtcccatcctccccagcgcacatatatcctttccccgtcccgaaaaagcaaaataaaaagcctcaagcccatatcaatcagcttgaagccttctatcctcatacttccattacataatatgccagtacactagacactgtcaaagtaaaaaaaattagtgctgcatatactgatagtcacataaggattatcaagcttctgcttcacatcaagaatgaccctccgtattgcgctgaaatatgcttcactgtcctcgtaaagcacgggattgcgcgcagctatgattcttagcccctggctgtccgtaccgcactcatcccttatgtcacagattaattccagatgctcaatcacgccgtttataaacaccccgcagcgctcattttctttgatagcagcattaatccaaatcctttttacttcttctatgccgaatcttttatcacctatgctgtaaaagttaatgatataccgctcagttatcatcttttcagccttttttattatatatattgctgtcccgtctgatttattcaggcagccgtttataaaatcaccaggagggttcccgtaatcagcacaatactgattacaatggagattgaattaattgcgcttgacagtccgatatcccctctcaaatccgcggtaaaggccggagctgcagatgcgatggggctgagggccagtatggccagggcctgtctgtactccagtccaaagggcagaaggaaataaaaggccgctgccagcgctatggaaacagcataccgtatggacagtattgttatgatttttcccatccggcttttatccaaggtcatcttaaatccaacgcccagcatgagcattgccataaatgcatttccattggcaatgatcccggtaaatgaaaccacaggcgctggcagggtcagatgcagtaaggacaggatggtcatcagcagatatgcatcaaacggcacggataataacagggtctttatgatgggcatgacgctgaacttattcttctcccccttagccattacagccacgctgtaagcgcctcccagacagaccagcgcattgcctgagtcaaacaggctggtggcaaccacccccatgggccctaaaaagccctgggcaaagggcatggtgaagttccctatattatatccggaaagattgacgatattaaatgccttttccccgccgcttttacctgcgctgatcaagaacgcaatgccaaccagcaggactccgccgcccagtcccagcatgctcatgagcagcatggacggcttcaggtcaattccggtaaaattcgtcacgatggctgccggaagcgtaatcttcagcacgatcctggacaacacataaaaatcttcctctttaaaaaatccttttcttctcagcatataccccattatgataatagccacaaaggagcctgccttcataagtatctctgtcatgcctgtttccctcatccattttcaagttatgcctgaacgcacgatatgtactatagcagaattcgcccccaaccacaacccatattcatccacaaatttcaccttttccgtattttcttccgctgttccatttccctgtccttcctgcattggcctgccatacccctgcccctgcttcggcctgccatacccctgcccctcctgcttcggcctgccatacccctgcctctgctttggcctgccatctgcgtccttccatctacagccttccatctacaaacatgccgcacaaaaaaatctgccgcccgccgcacatgacctgcagcagacggcaatatttcccagcccgaatgaatcagattcaaatcccaatcagccttccatcacacataccccagcagtcccggcagccacatggacaggatcggaacataggagacaaggagcagcacaatgaatatggcggcaaaataataaagcagcggcttaatcacattttcaatcttgctcttacccaccttaacgcctacaaacagcgtggttcccaccggcggtgtgatggtgccgatacacaggttgaatatcatcatgataccgaaatgcacggtgttcatccccagggcctggcagataggcaggaagataggggtgaagatcaggcaggcaggcgtcatgtccatgaatgtgccgataatcaggagcaggatattgatgatgaagaggatcacatacctgttgttgctgattcccagcatggcctcggacacggcagaaggtatccccgtaaatgccatgacccagctcatgatactggacacgccgataaggaaaatgatgataccggtcatctccgcgctgtccaggaaaatcttaggcagttcggaaagcttgattgacttgtagaaaaacagcgacaggatcaggctgtacacaacagccaccacgcttccctccgtggccgtgaagataccgcttatgattcccccgattacaatcacaatcatgagaagacacgggattgcctggaagaataccttaaccttttctccggcgctgtatttaaccgtactgcggtatcccttctttttggcaaaataaaagattacagccatacaggccagtccccataggattccggggatataccctgccatgaacagggctgccactgaagttcccccgctcacaagggaataggtaatcatgacgttgctgggcggaatcagaagtccggtgggcgccgtggcaatattggctgccgcagagaaatccctgtcatagccctcttcctcctcaatcggcccgatgatggaacccatggcagacgctgccgccgtaccggaacctgatatggcgccaaagagcatattggcaaccgcattggtgtgcgccagggcgcctggaatgtttccggtgaacagttttgcaaaattaatgagacggatggcaatcccgcccttattcatgatatttccagccaggataaagaaaggtatggccagaaggctgaacacggaaatgccggaaaatatcctctgtgccccggtaagcacggccgctcctgtattcagcacaggaaggatggcgcagatggacgacacggccagggccactgcaatgggaactccggccagaagcatgatgaccagtaacactaatataatcaatccacaggcaactgctatattcatctcctacacctcctctttcccgctgaaatccctgtgcagcatatccgccgcattcatcaggctgaacagcatgatcagcacgcccgccacaggcacgattacatagatgtatcccatgggcaccctcagggatgccgtggtctggatcatggtcagtttcgtaatggaaatgcctccgtataccatgacaacgcctgcaaatgcaaaggtcagtaaatcaatggccacctccaggtatctgcggccaggccctgtaaacttatccgccaggaagcccatgcgcatgtggtcccgcttgccgaacacataggcggaggccagcagggccatccaggtaaaggagtaggtcagaagctcctccgacacagtgcttgggcggttaaagaaatatcttgtcacaatctgatatgtgccgatcagggtcatcagggcgaacaggcaggtaatcacaatccccaggacccgcatgattccggctcttattttatgcatgttctccatcctactgtcctcccttggctttttcatttacttcctggatatacaggtacaggtctgcaatcttgggattttccttcagcatcttctcatgcaggggaagcaccttctgcttaaatgcatccacatccacatcgatgaattccacacccatgtcattaaccgcaatctgttttgcctcctcaatgctcttatcccactcctccatctcgacctgggtggaaagaagggccgcatccttgaaaatctggtactcctcaggatccaggccctgaaggaatttgaggtttgccaccagcatgtccggtaccatctggtgtttattgtaagcataatattttgcaacctcgccgtgcttgttgttggtaagggccagctcattgttctcagccccgtcaatcacgccctgctggatggctgtatacacttccccgaagcccatgggcgccgcggccgctccaaaggcattgaccatggcaacgctggccgggctttgctgtacccttattttcttacccttaaggtcctcaggggtgcggatgggcgtcttggcgtaaaagttcctggtccccgcattataccaggtcacaacccggaacccggcctcatccgtggactcatacacctgctccatgtaatccgtatcctgcatcacggacttatacacatcctcggagtcaaagaggtagggcatgctgaaaatctcatacacgcctgcaaatgtctccaggttggcggttcctgccaccacaaaatcaatggctcctgtctgggtcagctcaatcgccttctgggcagaacccaggatctcattggggaatatctgtacctcgtacttgtcccccagacgttcctccacatattccttgaatgcaagcaatcctatgtgctcgggatgtgtctccgactgtgcatgggatatacggatgatccgtttcccggaagtcacggaaccacagcccataaggcctgccgccacagcggcagacagcatgacggccgtcattttctttatgaatttcctcaccattttccattcctttccctttatacggcaaatgttccatacaatctgtacttattctggtctgtacttattctggactgaaatcctccataccataccgcataaaaagaaaccccgcggctgtacaatccagaattcattaaggttttggcgccttccttaacactttcttaattatatagcccggggcatttaatttgtaccgtaaaagtttgtcattggggaagaagattttgtcattttattaacaagaccagggggacatttccaaacacgccctaatgctgcgtccggctgtccctgtactccgaagggatcatgcccgtaatccgcttgaaaaccttggcaaaataattggaatcataatatcccacctgcattcccacatccttcacgctgatattccggttcttcaaaagcttctttgcctcgttcacccggaaattagtcagataggaggtaaaattctggtcaaagcactgtttaaacaatttgcagaaatacgcatccgaataattcatcacccttgcagcatcctgcatggaaatctccttcatgtaattattccgtatatactcccgcatggtttctgctgcctgggccatgcgggcggctcccgcgtcctccagcccatggccgccctgggggattgtgtccgaacgcccggatccatcccccatcccggccgcagtccccggtgtatccccaaatggggttcccggtgcacctcccttctgggttcccggtgcaaatccctcctggattcccagtgcacctccctcctgggttcccagtgcacctccctcctgggttcccggcacgttcccgcccaggcccaccggtatatgcccatccgggaccgtccccgcatccaagccggattcccgcgccttctgtaacgccctgcggtccgtaagacgcatggcctcctccatcaccgacaccagctcatcctcgtcacagggctttaaaagatagtccagggcacggattacgattgcccttttggcataggcaaaatcatcataggctgtcaggaaaatgatgacgcagtcctcatccattccccggatgtgctccgccgcctccgccccgttcatttccggcatggaaatatccatgatcacaatctggctccgctccctcttaaacacctccagggcatccgctccattgacagcctcgctgattgccaggctgtccccaaaatgcttcacaagccgttttgccagcgccatccgctcaatctgttcatcgtccgccagcaatatgcgatatctgttcatacttcatcctttccgttcaggtctttccctgtgaatgccatctgcaccaccgtaccgcagcccttgcagctgtacaggaacatttccccatccttatacatgccgtgaagcctccggtaaatattgccaagccccaccccggccgccttctcatccccggtcctaagcgcttcccgtatctcctgaagccgtccctcttccatcccaagcccggtatccgccacggatatccacagccgtctcccctccatccaggaacgtatgtggatcttcccgccctggcttctgggtgagatgccatacttgatggaattttccaccagcggctggagcgcaaaggagggaaccaatagttccagcgtatccggatggcagtcgcaggtaaatgtaagccgctgtccaaaccgcatcttctgcaggtacatataatcctggattaccttaagctcccgctccaggggcatgaccgagtccgacgatttcagattatagcggaacagccgtccaagggccgttatcattttctccgtcgtatcagcgtcctctatctgggccgtgctggcaatcatgttcagggtattgaacaggaaatggggattgatctggttcttcagcatctgaagccgcaccgcgtccagctgcttctccatctcatgcttttcagtcagcgcctcgatatagccctttgtggactccttcatggtacagaacgccctgaccaggctggcaatctcatcctgtccctctgcctggatatccggcccagtaaaatcattttcaccaatgcgccttgaatcctccgccagttccaccacgggccgcacgatgctgcggttcaccgaacgcttcagccaccgcaccatgagcagggccgccgccccccagagcacgctgatcacaggcacgacaatcagcaggggctgctgccttttataactctcattccccatctcaaccgtcatctgttccaggcggcccgcgtggttctccagatatccctggacgcggtagatggtatacaggcggtccatgtacccctcgtcgccctcacgcatgtccaggaacccatccctttccctggcatagttttcatacatattgaaaatggaccaggtcctggcataccggaccgccccgatcttactgtagtcaaagctcagtccctcaagtgctgcttctgatttaagacacgcctcatgaaaccgcttctggttttcctccgtccggtccctgaccagggtcacaaacgcgctgctctcccctgacatggcggaccagaaggacagggcctgggaattattctgaagcactgtgttaaatcccttcatgccaaagcctgcaaccaggatattggccacaatggacaagatgaccacaattgcagccgaaccagcgatatagcgcaccttccgttccagggaacaggaaagccagatgcggccaaagaatcccggattgcttttcttattctgttccgtctccacagcccgcctcctttcatcctgaaaacattctataatagtttggtctgttttggaagggataatcaaaaaaaatgcccgctggccacggccacggggccaagctgaagggcatctgtctggttctctgatttgtccggccaagttacagcttctggtcctcatccgaggccacataggttgcgatattctctatatcgcaattcagtatcctgcacaaatcattcactgtcttcatggaaatatccttgttgtgcttcagtctgtgaagcgtgctgtccgacacatgatgatgtttggtaagggtataccagttttcctccgatttttccaaagtcttccaaaagggtgaataatctatcatcttttactcctatgtaattggtctgtttgatagattaagcataaaatagatttcagatattgaatatcttcgcaattacgaatatactataggtattaggatgtataaattacatatattggaaatagaaaggcaggtaaatgacgatggattattttacggatgaaaaaatcaaacaattactggatgacgaggaggtggtgaaacgcctgattgatttcgtctccatggacggggcagcctactttgaggaggtccgttccaacctctccccaaaagacctggaagcgtatctggaagaaaatccggatgaacggatttatcttaaaaaagaatagaacggcttgtcatatgacaaaccgcccttcttctggttcttcttcaaaataatctttataatccacttctatggaatggcgcatgcgcttcatgctgtaatacaggtgttccttgagcgattcctccagcttcttttcatttccttctgaaatcagccggaacagttcctcatgttccccaatgatgcgcgtaaaatcagtctcagtgatgaaatccagcatacggaaccttgtatagtgaagctgctgtgcctgaagcatttcccaaagcttctggcgccttacagcgccaaaccatatggaatgcatctgggcgtccatgtggtaaaactgctccggctcaaacccggcctcctcaatcagcgcccgctgctgtgcaattgcatggcggatatcttccatcaccatgggcgtgcggttctgcatgaaatcccgcagcaccatggtttcaaccgcaacacgcatgtaaatcatctgcttgatgttatccaggctcagaagcgtcacataggttccccggtaggggacggtctctgcgaatccctgttcctgcaaaagcctgagggcgtcccgcacaggagtcctggacacgccgaagcggtcgcatatttcattttcacttatcatctgtcccggcttcagacgcaggtccagaatctcccgcttcagggtctcaaataccagctcgccgcggttcttgaaattcatctctcccatggtttaacccccataccgccaggcagccgcctgaatactgttaaggctgcctgacattcagctgcttcgatttattttggctgcttgccgatgtaggcaaggatgccgccgtccacgtacagtacaaggccgttcacaaaattagatgcctcggatgccaggaatacggccggcccgcccagatcctctgcctcgccccagcgtccggccggtgtcttggcaatgatgaactggtcaaagggatgcctggagccatccggctggacctcgcgcagaggcgctgtctgtggtgtggcaatatagccaggcccgatgccgttgcactggatgttgtattcgccgtactcagacgcaatgttcttggtcagcatcttaaggccgcccttggctgccgcatatgcggaaacagtctcgcgtcccagttcgctcatcatggagcagatgttgatgatcttgccgtggcccttcttaatcatgctggggatgactgccttggacacgatgaacggcgcattcaggtccacgtcaattacctgtctgaactcagcggcagacatgtcgcacatgggaatcctcttgatgattcctgcattgttgaccaggatgtcaatcacgccgacttccttctcaatggtggcaaccatcccgttcacggcatcctcatccgtcacgtcgcatacatatccgtgggctttaatcccctcttccttgtaagccgcaaggcccttgtcaaccagctcctgcttaatgtcattgaatacaatggttgcccctgcgcctgccatggcctttgcaatggcaaaaccgatcccataagacgcgcctgtaatcagcgcaaccttgtcgttcagtgaaaagttctgtaaataatctgtcatatccttatcctccttcattggcaggcatccctgccatcgtcatgtgttatccggctgctgtattatttcatctggttcggcatcatggtgtccatgtcgtcaaactccatgttctctccgcccatggcccagataaatgtatagttggatgtaccggcaccgctgtggatactccaggacgggctgatgacagcttcctcgttcttcatgatgatatgccttgtctctgttggctctcccatcatatggaacacaacgttgtcacccggaacctcaaaatacatgtaaatctccatgcggcgctcatgtgtgtgggccggcatggtattccatacactgccttcctccaatacggtcatacccatggacagctggcaggtctgaagcacatccggatggatgaactggttaatcacgcgcttattcgctgtctcagaagcgccgcacggtctcttggcagccttctcgatggggatgtaggtggtggtgaaggatgtatgggcaggcgcgcttaccatatagaacttagctggattggcagcgtcaacgcttgaaaaatacacttccctggtgccctttgtgatatacaggcagtccttatagcccatgttgaattcctgtccgtcagccacgatctttcctgccccgccaatgttgaagataccgatctcacggcgttccaggaagtagtgggtgccaaaattcttccagcagtcgattcccttgtcaatggaaacagtctctgtcacaggcatgcatcccaatgtcaccatacggtccacatgtgaatacacggcaaccacctcatctgccacgtacaggttctggatcaggaactcatcccttaattcctcagtggtgtagcgcttcacatctttctgatttgcagaataacgaatatccattacttaaatcctcctttaacttcgtgattgtattccaatcatcgtacttgtatacaacttttaatatctgtatacagattagcacagaccttatgtgttttcaattggcaatatacacaaatttggaatggaattctatacatgttaacaagagctgattgcattgtccttttgtttgttatatactcataaagaaacttgctcaaaagacctgaacaagaagaacaacaggaagaacagataaggaacaacattaagaacaacaaggataacaattaaggagaaccatcatgagaaagaatatcctggtcggccagtccggcggtcccaccgctgtcatcaacgccagtttatacggagtaatcacagaaggcggcagccaccctgaacagataggcgcggtttacggcatggtaaacggcattgagggtttcctctccggccactgcatgaacctgtcggaaagccttaacagtgaagacctgctcctattaaagcagacccccgccgcttacttaggctcctgccgttacaagctcccgaacaacatggacgcgcctgtctacgggcttctgtttgaaaagttcgcatcactggacatcggcgcctgcttctacatcgggggcaatgactccatggacacggtggacaagctgtcccggtgcgcgcgcctgcgccatgaaaccatatcctttatcggggtccccaaaaccattgacaacgaccttccggtcacggaccacacccccggctacggaagcgctgccaagtacgtggcctccacggtccgggaaatctgcctggacgcctccgtgtaccagcagcccgccgtcaccatcgtggaactgatgggccgccacgccggatgggtcaccgctgccagcgtcctggcaagaaggcatgtgggggacaacccgctgctcatctacatgcccgaagtcccgttctccatggaacgcttttttgatgatgtaaaaaaagccctggaccggcagcccaatgtagtaatctgcgtgtccgaaggcatacgtgataaaagcggcaaattcatatgtgaatattccaatgaagcacagcttgatacatttggccataaaatgctcacaggcagtgcaaaaatcctggaaagctacgttcgcaaccgtttccaggtcaaggtccgttccgtggaactgaacgtgaaccagaggtgcagcagcctcttagcctctgccgccgatgtggaggaggccgtcctctcaggccgcaccgccgtgaaacagtcccttaacggtgcaaccgggtgcatggtatcctgctcccgcgcagacggccctggctaccgcctggaattcggccttacggatgtgggcaatgtgtgcaacaaggaaaagggcttcccggtggaatggataaccccgtgcggcaccgacatcagccctgcgttccatgaatacgcccttcccctgattgccggagaaccggagcggatcatggaaaacggccttccccggtatatcagcagggccggggcctgttaagcctccggtcacacccctgcgttagctgcgaatcccccgtcaaccgggaggattaccccggttatgaaaccggccgcctcattatttaaaaggaacatcagcgccccgttcagctccccgggcttaccaaaacggcccatgggagtggcggccagcaccttggccgtcctggctgccggagtgccgtcctcctcatacagcagcccctcattctgctttgtcacaaagaaacctggggcaatggcattgacacggattcccgccctggcaaaatgcactgccagccactgcgtgaagttgctgagcgcagccacggcgccgctgtataccggaatcctggtcaggggccgcagcgcgctggccgaggaaatatttaatatattgcatccttccctgcccaccatatcctttgcaaatacctggcaggtaaggaacgcgcctaaaaagttcaaatccagcaccttctgcacgcccctgtattccagatcaaaaaaggtagccacatccgcctcaatatcccccatctcaaaatactccttggatgtattggcacatgcctggttgcccccggcgccattaatgaggatatcgcacggtccaagctcggccagcaccctggcatggacgctttccagcctgtccttgtccatcacgtccacttcataggcagccgcattgcctcccagggcctgtatctccctggccgtccgctccgccgcctccaggttgatatccagcagcgccaccgatgcccctgcctgcgcaagggtccgggcaaacataccgcacaggatgcctcctgctcccgtcaccacagccatgcgtcctgacagatccaatccaaactccatatccatatacctccttacatccattgcttagcatgctttatcattcctcagcatacattaccattcttcaccatgcgttaccattcctcaccatatatttccattcctcaccatgcgtttccattcctcaccatgcgtttccattcctcaccatacgtttccattcctcaccatacgtttccattcctaagcatgcattaccattcctcaccatgcgtttgccacatcaaaaaacctgcataataaggaaaaaggaccagcccatcttcccactgatcctttcccatcgctttatgaaacatatctttcatgaaatcattttacaaaatccaatccgcagaaccgcccacaaccgtccacggattaccggctcatcttctccactgcctcaaacagtccgttcagataagttgcgcccagtgccctgtcgtacaggccatatcctgcgcgtcctgtctcgccccagatcatacgtccgtggtcaggtcttacataaccgtcaaatccattgtccaccagggccttcacgatgccgaacatatccagggaaccgcaggaggacagatgtgccctctcctcaaatccattgtccagcacagccacgttcctgatgtgggcaaagtggatcctgcccatggcggcgtacttcccggccatccttaccacgtcgttcttggcagagcagcccagggaaccggtgcacagcgtgatgccgttgtgcttgtcgtccaccagctttaagaaacggtccaggttctcctcgcaggtaatgattcttggcaggccgaaaatgctccaacatggatcgtcctcatgaatcgccatattcacatcgcactcagctgcaaccggaatcacgcgctccaggaaatactttacattatcccacagcatatcctcggtcaggttgtggtattcctccacaacagccttaagtccatcccttgtgtagctggaatcccagcccggaagggtcaggtcgctgtcgctgtttaacggattcactgcatctacctgctcctgataatataccagggaagtggaaccatcgcccagctcatggtctaactgggtccttgtccagtcaaataccggcatgaaattatagcatacgcacttgatgcctgcttcagccacacggcggatgttctcacagtagttctcaatatatttgtccctggacggcttacccagcttgatatcctcatggaccgggatgctctcaatcacatcaaagccaaggcctgcttcctcaacctgcttttttaacttagcaatgctctcgcggctccatacctcgcctacgggcacatcatacacagcagttacaattgactgcatgcccggaatctggcggatgttctccagggttaccttgtcatcttctccgtaccatctgaatgataatttcatgtgtaaactcctccttaagaattgttgttggtatctgtcccttaacttagttttattataacagattcaggattttcgtccatagtgatacttgttgtgcatattgcaaatgttgttgtttcatgctaagattgggtaaaataaatcaggtccgcacgaaaaccggccggaaaggagactccccgtgaaaaaacagatatcctcggatttcaacaccaggcaatacatgcagcccgttgattttgagctgttctattacaatgatgccacgcttaaatccgtggccgcccatgtccatgattactatgagttctacttctttctggaaggtgacgtggaatatcacatgggggataaaagctatcagctggaatacggcgactgtctcctgattcctccgggcgtcccgcattttcccgaattcctctcccatgacaagccctaccggcgctttgtcttctggctgggaaatgattattaccgcaaactgcgccaggcagatgaggaactggcttacggctttgattatgccgaaagccatcaggtctaccgcttccacacagataccatcactacccaggagattcagggaaaactgaccgacctgattgaggaatccggcagcgggcgggccttccaccgtctggcatccgaactcatggccgtatcattcctggtctatatcaaccgcctgctctatgacagcctgcatcagaagtccgcggtctacgaaaatgtcctgtacctcaatatctgtgactatataaaccagcacctggaaggagatttaagcctggacagcctctccgcctttttctatgtgagcaaataccatatctcccacatattcaaggataacatgggcatcccccttcaccagtacatccttaaaaagcgcctgcatgccagtaaaaatgcaatcctgtccgaccagccaatcagccatgtgtaccaccagtacggcttcaaggactataccagctttttccgggcctttaaaaaggaatacggggtttccccaaaagaatacagggagcagcaccgtctgcctgcacagcaggactataccatttaggagaatataaaaccaggagaatatcaaatcatgcagcacagaacccctatttcctttgacagctacacatcctgcagcctttgtcccagggcatgtaaggccgaccgtaccagggccggccattccatggctgaagataccaaggctgaccctaccatggctgaagataccagggccgcgggcttctgcggctgcacccatgagctgaaggctgcccgcgccgccctccatcactgggaggagccttgcatcagcgggccggaaaatggccccggcggcagcgggaccgtgttcttctcaggctgtaccctgcgctgctgtttctgccagaactgggagctgagcagccaaaactttgggaaagagctgtccaccagacagctggcccgcatcttcctggatctgcaggccaagggcgcccataacatcaatctggtgacaccgacccagtacctgccccatatcacggcggccctggaccttgtccgccctgagcttgccattcccattgtctacaacagcggcggctatgagaccattgaaaccatcaaggccctggaaggttatgtggatatctggcttcctgatttcaaatattatgataaccgtctggccctcagatattcccgcgccggtgattactttgaacgggcctccctggccatccttcagatgatacgccagacaggcgcccctgtgtggcaggaatcagacccgtccctcatgcaaaaaggcgtcatcatccgccacatggtccttcccggccataaggatgattccattgcacttctgcactggataaaagagaacctgccccaggaccagtacctgatcagcctcttgagccagtacacgccctatcaccgcagcagcagctatcccggcctgaaccgccgcataaccacctacgaatacaaccgcgtggtggacgccgcactggagcttggtctcacccatggtttcatgcagcaaaagagcagtgcaaaggaggaatacacgcccccctttgacctggaaggcctgtaaaacccacaaaaaaagcgccccttcatccgaaacgcccaacattccctcttatccttatcatcaaggcttcctacacaacatagaagacggatatcgaatctttgactaaccacgttctcgattacgatatccgtcttctgactatttcgtccattggaccaagcctcacttttctgaaacaattgtttctttttacttctatattaagttgttacacctctctactattgctactacgctcctgttacttcatcttaccagtatgtctgattcattttccttacttcttgcttactatactatccggtatcaatctatttcgttctaatgatactttctcgtcatatcactaaaccgatacacgatttttattgatactcttgagatagctaattgaaaatgctatcaaccacttaataataaatgtttctacttaacagcttgtttctttaaattatctctttaaatactgcaattgctttttaactcttcaatttgttgacttgcttctataatattaaatacttttcttttgtgaacttacccattcacttggaacttctttaatctattgaaactttgttactctttgaatcgtttaccaaccgattggattcttttgtttctttaaatcaattacttaaattactttactgtttgagcgttttgcttttagtagattggtttctcctggtctcatatataataaatttctttgattatatatgaaactaaaattcagtctttggtggtccgtacctcctttgcttggatttaagttacttgtgaactgattgtctacagttccttgaattctttttgttctctgttcttttgttgtctttattatagtaaatggcctgtcatttgtcaatgcttttttcgtttttttataatctttttagtttatttatatttatagccaattaattacaattgttcctatttttatacaattgatgatgcatgaatcttattaattgtttatattttccgataattatgtgaaatttaagcaaatttacgccagttccggcatgtccagccatatttattcctttatggaaaataacttatcacgcccctgatactcactttttatgattccgaacatatcttcaggactttctttgcagccgccctgcagccataatttgatgatccttgttatcccacttttaaaaaattccatatgataaacaataaaacggttttggaaatgctgtcctgcaaggttcatatcataagtgatgatcttgtagttatcgtcataccccagtttgaagtaggtcttatagaatatctggttgtcctttatgtgacggaacagtttaagataatcgttgctgttaaatccctgtgtgatttcatcccggtataagttggataaatcagcttccagtttgtcccgtattgaatcggccaatccatatatatccgtataatttgcataaaaagtcgtgcggtttaatttggcctgtttacagatatccgatatgctgatttcagctaattccctggtttggagcatgtcaagaaaaacccgttcaatccgttcaatggactctttctttcgtttattattgggtgtattcataaaaatctcctttatcccaacatttgttgggaaattgatgattgttttaggttatcaggaacattatactatattcagattaaagcaacaactgttggtttaataaatataacattcaggaggtcttttacatgaaaaaaagtagttttgttgcaatgatgtcaggaactgtgagcggtgtgctttttgcccttggtatgtgtatggctcttatcccggaatgggcggccttccggcccggacttgtgtgcggctgcgctggtctgctgatggccctgattacactgcttgtatggaggaaaatggagcataagaagcccatccggctttccggaaaaataatttttacaatgattgccgtgattgccggtacgctggctttgggcatggggatgtgcctgaccatggtatggggcaggatgattgccggaaccgcaaccggtcttgtgggaatcctcatcctgatctgcctgattccattgacaaaaggcataaaagaatgagaccgttccatctgccgcctccgccatatcccaaaccggaactggcaggaaattcatacgcagtcagcgtgtggggtatttttgttaaagaaaggaatatgaatgatggcaaaatcaaaccttgtaaaggcaaatgaaaaaatagccaaagctgtcacagggagttttcataaaatcgaacgcagtgtaatagacggatacacaaaaattgaagacaggtttgtagacgcctatcttacgaaagacggcgaaaccgtttccggggccaaagaaaggttacggcagaaacaggcgcagcgccagaaggataaataggcagacattcattcccagaccaaggaaacgcgccgccccgcctccttcacctgtctccccgcccgtctccggaaaagtcaagaccaccggggagggcaagcacacttgaagcgctaggaaagccacacgggggctttcctgccttgattactgataagcaaaccaggaagagggtgtcagggaccgcgtaccgcttatactatccttgacatcctctccctattttgctgcctgcacctttatccaataaggcatagtttcctaatttatatttttttcaatatattccgatataaaagtcctcgatgattgggcgatttcctgatatacaaacttatacaaattatgtggaaagtcaaatacttcgtattgtgaaacttttatatgatttaaatattgtaaagaacattcaatccaattctcttttttgagtgtcgtaccttctccgttcgataaaaagaataacattggaacctgcagatatggatcatccctttccactagaccaatcgcatttctcaagttttcagcttcactaatccaattttggttggccagattacggaatgccaaaatttcaatttcattcttttccatattggaaatatcctgttctcccattaattgttccactaaggcactagcggttgcttttcggcagagtgcatccactgacatccctttcagtttttttgtagcctcttctacattaaactccctgtaacaatctggcgttgcagggtcaatgccaaggataccagcgatttcaaaagggtactgctgtccccagcggagagcctctaaaaatcccatactatgtgctgccaacacaacaggtgaatttattcctaatttttgtaatacgcttctatattcatgaataacgctgtcaatatcccgattgttttcagccaggtcactgcgtccataacccaacttttcaattccaattacttgataggtttcggataatgattttgccagagttttgtattccaagctcgggaaaggtactcccgacccagacaaaagcaccagggtaatagagccttgaccataacaatatacaaaatttttatagccgttcacttccacaaatttttccatatacatctcctcccaaattttgtcatgcacgccttattatccaaaggcgcatatctcacttcgggccaacttggcctgaagctgttttccatacccgtattctaccattccccagaaaatctgtccatcttgttaccgcttcctgcccctctggtttaccggatttctcgccagttcggacttttgcgatacgggttagccactgtttttctttctccgtcaatctttctccatcaaacggctttattttagctttgcctgcctgcggaaaagcattatcagcttttccgcccggctccccctgaagtccgccacttcctccatatcgcatttcaattccttggtggcggagttctccggccgctggtgctgtcctttgtgggtttctttcaagtcctccatgatacccgtctatatcgtcatgtacccgacggattgcagcacaggagtttcttttatctgaaaatattccctccccctgcagagcaggtgtttttttgtgacataaacaaagcagaggtttacgcagcctccggccacctacctctgcctctaacctctaacacctaacctctaacacctaacctctaatacctaacctctaatacctaacccttcatcccgacctctaatcccgacctctaatcactctcttcaatcccagctcctaaaaccggtccacttcctccttagaaggaatcgaaggcgctgcccctggccgtgacactgcaatggccgctgccttggccgcccattccagcgcatccgccgcatccatgccctgaaccagtcctccgatgaagaacccggtaaaggtatcccctgctgcagttgtatctgccaccttgaccttgtaaatcccctgcttcaagagccggtccccatccctgtaaagggatccgtcgccgcccaatgtcagtacgattttggcggatgggaacttggcagacagcttcttaaggagttcctcgccctctccctgctcgccgcagatatcccctgcctcaatctcatttaacaggaaatagtccacatactcaagcgggtatcctgcaatcttgtcatccatgggcgatgggttcagcacaatcttcatctgcctttcgtgggccttctccatgatatagccgatttcgcttatctcattctgaagcaccagatagtcccctgcctcaaaatggctgatgacctcatccaccattgtctttgttatcatctgattggcgccgccgtataaaaggatacagttgcccccgtcctttgccttctggatgatggcatgtcctgtctttccttccagtaccgcaatcagctccgtgttaacccctgcgcttttaagctgtcctaccaggaaatccccgtcccctgtcccgattgcccctgcgtgccataccgctgccccgctcttactcagggcaatggactggttcagtccctttccgccggaaaacacattcatggtttctgacgataaggtctccccgcctcttacaaaatgatccacactgtaggtgtaatcaatattcaatgacccaaaatttaaaatcttcatgtctgtccttctcctttacttaaaatatgccaaaccattccatctgattatacgatatttcatgggtttgcaaaagtgtttcttaaccttttctgcataaaatttacagtttgcccctgttaatcagcattcacgggcaccatttttgccacatcctggggaatcctggtcagatccctctccacaatttcataaatcactgcatccggcggattttcctccagcatggtgtaatcaaatgcctgccaatggtaaaaatccatattggcaaaatacctgggcagcttgtccatcagggccgtgccaaaggaatcgcggattacggcaatgcgcctgccgtccggcgcccccggcgtggacatgtggaggatgttcttatcccccagcacatcctccacatggacggccagattgtcgccaaagcctgtgatgaccgcattctcatcactgcagtattgttccggcagatggaacaggttcaccagatcacctggcgcagccgcctcataggtcacggttacatcctctatgggcactgcatttccccccaatgcctctatgatcatctgggaacccacatatccccctgcaaagttccagtgggtatccgtcttatagtaccatgtataatcccggttggcgttaaaatactccctggggtccagcaccgtgataccggaatgtttcccaagatattcctccagctgggacggacggttcccgtcccagacccgctcatagcagtccggcatatattccctgtaaacgccttccttgttgggcgggatcatcatcaggaagggaatccccctgccctcataatagctggcggcccggatgatctcattgccgatcatggccacgtcatcctgataaaaaggctctgtgccaagggcgtcaaacaggctcatcccgcctgcaaaaaagtaccagccctctttcccccgtatgacgtcctgggaatccgcataaccgaacagcttcaggttaagcacggagttaatgctcaggaaacggttcctgaacgcggcatggtcattgatatagctgtccacttccgaaggatatgcctcaaagtcttttgcctcaaagaccgggaattcagccaggctccggttctccgcactgccgctgtccccatttccttttaccagcgggaacagaaggttcgggagaagcaggatagcccagaagcccccaatcattattttctttatcataaatgtactcccttatatgtatcggaatcatgtatcagaacctgaagtagatgaacgcctggtaggtgctgctgaccatcaggacggtgcagagcaggaggagtgccgccatgacagccacatccaaagcccccgtccgttcctcgtcatacagacgctttgtaagccccggaaacagtttctgcacaggcccgcaaaagcagaccgccaggaccagcaggaaaataatcctgttatccatgaaaatcctcaggttccacagcccagccctgggcgacagcatggccgtcaccagcaccttggcctgatgcaggctcccaacccggaacagcagccagccgaacatgaccacaagcagggtatacacatgattcagcgccttgcagggattcttttccagaaccttgccaagccacagccgctccgccacaatgaagattccataataaatcccccagcagatgaagttcatgctggccccatgccacagcccggttgccaagaacaccacggacagattgatgcaggtccttgtaagccccttgcggttgccgcccaggggaatgtagagatactgcttaaaccaggtggacagcgatatatgccacctgcgccagaactcgctgatggaggcggacagatacggatagttgaaattctcctggtaggtaaacccaaacatccgccccagcccgattgccatatccgaataaccggaaaagtcataataaatctggaggctgtagagcaggatcgtaaaccagacaactgccgttcccagctgttccaggggaaggccccatatccggtccaccacctgaccgaacatatttgcaaacaccattttcttggcaaggccgtaaacaaacctgcggatgccatatgcgtgcatggaaatgctttccctgcgctcccctatctgcggctccagttcgttgtatttcacaatggggcctgaaaggatctgcgggaacagggatatgtacagggccagccggaatatatttttctggattggctttacgccccggtatatatcagcaatataggaaacagcctggaaggtataaaaggaaatgccgattggcagcgcaatgttcctgggtatgaagccctcctttcccattacggtataggcaagctccaggaagaagttaaagtatttgaaatatcccagaaggcacaggttggccccgatgcacagggccagcgctgcccgcttaaggcccgtcctgtccccaagccttccgattgcaaggccgaagaggtagttgaacaggatggataagatgaccagcgctacataccttggctcgccccagctgtaaaacagaaggctggcaatgagcaggactgcatttttaagcttcctgcccggcgccaggtaatagacaagggccaatgcaggaaggaaaaaccatacaaatgtaagtgaactaaaaagcatatggttctgctacctttcttatgtatcgtattctatcatggggaaacggcccccaatcgcagataacgccatcaggaaacctggcgccatctcctacgccaaaggcatcgaatcctgccgcggtatcttcctgcgtatcttgcggaaggtaatcatatgggcaacggccgtgatggcccaggacaccggataggacagatagagcacgtccagggaacggtatgccgcaaacacggtaaatacccagagcacacggaatccgcaggcccctgtcagggacacgaacatgggaatgatggaatatccaaggccgcgcaggctgcccaccatacagtccatgatgccgcagaggaaataagtgccgcagatgatttccagcctcagcatgccgtagtggagcacctgggcatccgaggaatagattcccagcagcaaatcgcctgccagcacggctgttatccccagcgtgatgcccacaatggtcaccacagccaggcagatatacatgatcctgttaatacggctgtatttcctgccgccgagattctggctggtaaagctgagattggtctggtacaccgcgttcatggctgtatacacaaacccttcgatattggcggaagcggtgttgccagccatggcaatggagccaaaggagttgaccgaggactggatcagcacattggaaatggagaagatggcgccctgcatgccggccggaagcccaatcttcacaatccgtttcagcttctttggataaatccgcagttccctgaggttcagcttcagggcgcccggggcttccatcaggcttttcagaaccagaagggctgacacatgctcggatatgacggttgcccagccaaccccgtccacgcccattccaagacctatgacaaagaacaggttcagcgccacattgaccacgcctgccatgaacaggaaatacaggggccgtctggtatccccgattgccctcaggatggccgcgccgaagttatagaccatcagcaccggcatgcccaggaaataaatcctcatataaagcacggcctggtccagcacgtcatccggcgtccccatcaggtggagcaggggcctggctgcaacccctcccaggattaccaggaaaagcccgcttagcaggcttgtcagcacggccgtgtggacagtctcgctcatgtccttttccctctggccgccataatacttggccaccaggacattgacgcccacggaaaggcccacaaacacattgataagcagattgataagggaggaggtggagcccaccgccgcaagggcgctgctgccggcaaaccggcccaccacaatgatatccgccgcattgaacagaagctgcaggatgcctgacatcatcaaaggaacggaaaataaaaggatcttgctcagaagcgggccattgcacatatcaatctcatatgactttttcatctcacatactatctccgtatattctgttttttatcttaaccagggcgccctgccgccgtggccttctgccggttaaggaaccggggcgtgtctgcgtgaagaatccatggaacgccaggcatgcgtacgtttttcagtttagcacaagggctgtttttttacaatgaattgagaatttttcttgacattttcttcctggtcacttaaaatgtagcaagtgataagggagtagttggcatgcggcgcatgtaataaagtcaacatactgatagtttctatctggctttatttcaaataatgagacttatctacggcatggaaaccataattccggcagtctgtgaagacaggactcccggaggataccgtacatggccgtaggtgggtctttttttatacaccgttccatatattaaacaagtacgggaggattcactatgtcgttaactgagctgtttatcattgccgtggggctgtccatggatgcattcgcagtctctgtctgtaagggactggccatgccgaggatgaactggaaaggcgcatttatcgtgggcctgtatttcggggggttccaggccgccatgccattgttcgggtacttccttggatccaggttcagcatggccatcaaggcatatgaccattggattgcgtttatccttctggccctcataggtgccggcatgataaaggaatcccttgaaaaagacgcagaatgtgccgacgcctccctgggtgtccgggaaatggtcctgctctccgtggcaaccagcatcgacgccctggccgtgggcgtcacctttgcattcctggacgtggacattgtccccgccgtgtcctttatcggcgcggtcacatttaccctgtccatggttggcgtaaaggttggaaatgtcttcggctgcaggtataagtcaaaagcggaactgaccggcggcatcatcctcatcctcatgggaatcaagatactgctggagcatctgggattatagtggagcggactgtccacgaagcgggccagggccgtgtccgtgaatcaaaagtgcaggttattcctgtgcttagattcacggacacggccctgtttttccctccggcccctgctgtctacgcgttcttcaccgtggcgatatcaatcagcgtcagctccttggcccggttctccaggctggtcacaagggctgccgccgtatccagggaagtcagcacgttcacgcctgtctcgattgcattgcggcggatgatgaagccgtcgcggctgcgctctgccccctgggccgggatgtcgatgatcaggtcaatctgatggcccagcaccaggtccaggatattgggtgattcctgctccagcttgcggatttcgtatgcctttacgccgtttttgttcaaggtccttgcggttccccgtgtggcaaatatctgatagcccactgccgcgaacctgcgggcaatgtccactgcctcctcctggtcgctgtggcgcacgctcatgatcattttcttatactttggcagacggatcccggctccctcaaaggccttgtacagcgcttcgttgaaggtctttgcaatgcccaggcactcgcctgtggacttcatctccggcccaaggctgatgtccgcgcccctgatcttctcaaaggagaacacgggcatcttgatggcaatgtaatccgctgccggctgcagtccgggcctgtagcccagctcccttatggtgtgtccgcagatgatctgggttgccagcggcacgatgggtatgcctgtcaccttgctgatgtagggcacggtacgtgaggaacggggattcacctcgatgatatacacatcgtccccgtccacaatgaactggatgttaatcattccctttacatgaagggcccttgccagcttctcggtgtagtccacgatggtgtcaatgttgtgctgggtgatatccatggccggatacacggatatgctgtcgccggaatggatcccggtacgctcaatgtgctgcatgatgccaggaatcaggatatccgtgccgtcgcagatggcgtccacctcgatttccttgcccatgatatatttgtccacaaggattgggtgttcctgggcaatcatgttgatgatgccgatgaactcgtcaatgtcctcgtcgctgatggcaatctgcatgccctgtccgcccagcacgtaggagggccttaccagtacggggtagcccagctcatgggcagcttttttggcctcttctgccgtgaatacggtgtgccccgcgggtcttgggatgttacactgctccaggatttcgtcaaaacgttccctgtcctctgccgcgtccacatcctctgccgcagtgccaaggatgggaacccccatcttcatcagggcctctgtcagcttgatggctgtctgcccgccgaactgcaccactgccccgtccggcttctcgatgtccacgatgctctccacatcctccggggtcaggggctcgaagtacagcttgtccgcgatatcaaaatccgtgctcaccgtctccggattgttatttacaatgatggtctcatagccttcccggctgaatgcccaggtgctgtgcacggagcagaagtcaaattcaatcccctgtccgatacggatggggcctgaaccaaggaccaggacctttttgcgcccttctgtcttctctgcctcgttcatgcttccgaaacaggagtaataataaggcgtctcagccgcaaactcagccgcgcaggtgtccaccatcttgaatgccgcccggatatcattgtcatagcgctgcttcttgatttcttcctgggcaatcccggtaagccttgcaatcacgttgtccgggaattcaatcctcttggcctctgcaagaagctccgtggtcagacgggccttgccttccccaaccgccttaagggcctgttccatttccaccaggatggaaagcttgtcaatgaaccacaggtcaagccgtgtgatttcgtggatttcttcataggaaatgcctctgcgcagggcctcggcaatcctccaaatcctcatgtcgtccactttttccagctgttccctcagctcactgtccgtaagcccggtaaaatcataggacagcaggcagtccacatgctgctccagggagcggattgccttcatcaggcctccttcaaagttggtgcagatactcatgacctcgcccgttgccttcatctgggttcccagggtacgcttggcgctgatgaatttatcaaatggaagccttggcatcttgaccacgcagtagtccagcattggctcaaagcttgcgtatgtcttctttgtgaccgcgttcttaatctcatccagggtatagcccagggcaatcttggctgccaccttggcaatggggtatccggttgccttgctggccagggccgaggaacggcttacacgggggtttacctcgatgacgcagtattcaaagctgtccgggttcagggcatactgcacgttacagcccccggtaatgcccagttcgcttatgatgtttaaggctgaggtgcgcagcatctggtattccttgtcgcccagggtctgggatggcgccaccacgatactgtcgcccgtatggacgcccaccgggtcgatgttttccatattacataccgtgatgacattgcctgcgccgtcacgcatgacctcgtactcgatttccttccagcccgcgatgcagcgctccaccaggacctgtcccacacgggaaagcctgagtccgttttccaggatctcggcgcactgttccgggttcgctgcaataccgccgccggagccgcccagggtataggcaggacggagtaccactggatagccgatctgggccgcaatctccagtccgtgcttcacatcctccacaatgtcggaaggagccacaggctcgccgattttctccatggtctccttaaacatctcgcggtcttccgccttcttgatggtcagggccgtggtgccgatcaggcgtacattgtgttccttaaaaaagcctgcgtcctccagctccatggccaggttaaggcctgcctgtccgcccagggtgggcagcacgctgtccggcttttcctttaatataagctgttccaccacttccacggtcaggggttcaatgtaaacccggtccgcaatatccttatccgtcatgatggtggccgggttggagtttaaaagcaccacctccacgccctcttccttcagggaacggcaggcctgtgtgcccgcatagtcaaattcagcggcctgtccgatgatgatcgggccggagccaagtacaaggactttcttaatatcaggattctttggcatcagtcattcacctccatcattttcaggaaacggtcaaacaggtaaccggaatccagtggtccggggcaggcctcggggtggtactgcaccgtgaaaatattcttgcccacatatttaagcccctcattggtgccgtcatttacattcacgaaggcgggaaccgcgatatccggggtcactgtctccatatcaaccacatagccgtggttctgggatgagatatatacccttcctgtttctaaatcctttaccggatggttgcctcccctgtgtccgtattttaacttataagtatccatgccgttggccagggccatgagctggtgtcccaggcagatggcaaaaatcggcacgtccgatgcataaagtttctttatttcttctatgacagccgtattctccttggggtccccggggccgttgctgagcatgatgccgtcagggcaggctgccagcacttcctctgccggggtgtctgcgggatatacggtaacctcacagccaaggctgttcagggaacgcgcaatgttcttctttgcgccgtaatccataagggccaccttcttgcccgcgcccgggaagctgccagccggaaggccgtctttgccggaaagcctgctgttgtctgaaggaccgctgtcagcaaggctttttccaggaagcacatacttctccttcgtggtggtcttcatgaccacgccggtgacgccgtactctttcatgcgctttatgggtccgcttaaatcggtatattcactggtggtgatcataccgttcatggtgcctttttctcttaagattttggtaagggctcttgtatcgataccgcagatgccgggaatgtcgtggcgttttaagaagttctggatggtatcctcgctacggaagttgctggggattcttgataattctctaacaatatagccgtccggccagggttttgctgattccatgtcttcatggcagattccgtaattgccaataaggggatatgtcatgacaactgcctgtcccgcgtaagacggatcggtcagcacttccagataaccggtcattgatgtgttaaacacgatttcactgataacttcacgttctgaaccaatacttgtcccggtgaatacagttccatcttccagtatgaggtatgctttcatatgggggtacctgtcctttcttatgtgtttgctcatgggccaagttatctcagcccaaattgtaaagattatactgtatttcgatttattattcaatagctttaagggctaaatttttttgtttcaatctaatagttttttagaacaggccgggccgcaagcagggcctaaaaaacagcatcagaccgcccggcataagcggcctgatgcccatctgtctgttatccctgctacaccagctccgcaatcctggtaatccccacatagatatgggatatccgataccatgtggcaaaatccaccacgccggtctggggaagcccgaaaatggactggaattcccgcaccgcatccgctgtccttgggccgtaaatcccgtcaggggtcacccttgggatggcagtataaacagttgcaatcatatccagctgttcctgcatctggcggaccttgtcgcctgtgctgccaagggtcaggtcattgccgggccaggatgccgggataccggatatctgctctgccgtgttgacatagatgctgtccccataaaaataccgcaggatttcaattggactgtaaccctgttcccccagggagcatgacccccactgtgtcatccagtttggacactgtacctggcgcccgtcacagtactgggtcaggatgggctggcgcacgcctggcctggacaggtaattgtcaaatatctcatctacaatcagggaaatgctctcaaatatgttcctgccgtatatccatttatggtcaaaggcagtggaggatgtgatggtaaaatcatacccctggttcctgtaccactccgtatagacacggttcagggtaaatgacatgatggccagcacgttggccgtgatggtggccctgggccaggtggagtagatttcactggaagccacatttttaatgtaatccctgtagggcacatagtaatcctttgccgtccggtccgtgggcgccccgtcatggaccaccacggtctgggggaccaccacgcggcttaagacgatttccccgctctcgttcacaggctttatctctgcctctgcaatcttgggcggataattcccataaagggtgtggtccggaatcacaatcgggtcctcgggaggcgtcccctcccctgccggcgtcatgctgaccggctggatggcagtggactcagccagtatctcggttcccgatacctccaccgggtcaaatccctccgcctccacggtcaggttgtattccgaatatggctggatgatgcctggttccaggctcagctccaccggaggcgcgggaagggagaccgtctctgtctggcctgaactgttggtctgaagctgctccagggcgcttgttggctctcccttgtaactgattgtaaccctggcattctggatggggaaattgttctggatgttgattacattaatctgcagcattccactggatgtccgttctggattggttgccatgtaatacctcataatctcttatcattacctaaatataagcagggccttcttattatatgcatgtcccggttggaaaaaggtattttacatttttcaggaaatgcttgacatccgtgccctgcctgtctataataacattcaattgaatcaatatcttcagggcagggtgcgattccctaccggtggtacagcccacgagccgcaaggcatgattcggtgtgattccgaagccgacagtatagtctggatggaagaagatggacatggatgttttatgatggatggattatgatggattatttatcccggtcagtagtatgtccgggatggatttgaagactggtcccatccgtatgaagaatgttaatggctgccctggtatgacgacataccggggcattttttatcataacatgtaaagcagaccgtattatgttgatttcacccgattggcggatgcatctgatagtggattcatctgatgatggatgcatctgatggcggattcatccgatggtggatgcaggccaatcgatgtacggatatcggcatatctcaaagattccccttccccccgccctggacctggtgttcaaggcgttttttattccattcttttacattttcccatcataaaaaggaggtgtccaaatgtcggaaacatccgataacatctacatgggccgcgcccttgcccttgctgcaaaaggggagggccgcgttaaccccaatcccctggtgggcgctgtcattgtcagggacggcgccgtcatcggccagggatatcacggtttttacggcggtccccacgctgaacgggccgcccttgactccctgaccgcgccagccaatggggccgtgctctacgtcacattagagccatgctgccattatggcaaaaccccgccctgcacggatgccatcataaaaagcggcatccgccgggtggtcatcggcgccagggaccctaacccgctggttgcgggaaaagggattgcggcccttaagagtcacgggattgaagtaatccagggcgttttagaggaggaatgcatccgccagaatgaggtcttcttccacttcatccgcaccaggcagccctatgtggtcatgaaatacgccatgaccatggatggcaggacagccacatccggccgcctgtccagatggattaccggggaccaggcccgggagcacgtccataagaccaggaaccgtttaagcgccgtcatgacagggcttgggaccatccttgcagatgacccgcagttaacctgccggatcccgggcggaaggaatccggtgcgcatcatctgcgatacccgcctcatgacaccgcttacatccaacgtagtcaggaccgctccccatgtcaggaccatcctggcaacctgctgccaggaccctgccgccatggctccctttaaggatgcgggctgcgaaatcctgatcctgcccgaaagggacggtcacacggaccttaggttcctgatggaacgcctgggcgggatggatattgacagcgtcctgctggaaggaggcagcgccctcaactggtccgcgctggaccagggcattgtccataagcttcaggcctacattgccccaaagattttcggcggagaaaagggactttgcccggtaggagggaaaggggtggaactgcccggaatggctttctccctggaacccccaaaaatcacggtccttggcagggatatccttttagaaagcggggtggttccttgttcacaggcatcatagaggaaacaggaatcctggtgtcctccatccgcggcccccgctcctgtgtgttggatatcagggcgcgcgccgtcttagacggcaccttgcccggtgacagcattgcggttaacggcgtatgcctcactgcctccgctgtctcatcaaccggattcacggctgatgtcatgccggaaaccatggcgcgtaccggtcttgggtccatgaaccccggcgcacttgtgaatctggagcgggcattggctgcagacgggcggttcggcggacatattgtctccggccacattgacggcaccggaaccatttccatgataaaacgggaaggcaatgccatctggtacaccgtccgcacctgcccttccatcctggaccttatcatagaaaaaggctccattgccatggatgggattagcctcaccgttgccagggtgacggaccgggatttttgcgtatctgtcatcccgcacactgccggccatacgaacctggtccgtaagacagtgggaagcacggtgaatctggaaaatgactgtgtggggaaatatgtagggaaatacctagcaaagctgcttacagtcccgcgccacgacagccatcccgggtccgccgtgacggaggaatttttattaaggaacggtttttaatcttacccatccatatgaatccacaaataaaggaggttaacatcatgtatcactttaacaccgtagaggaggcgctggaaagcctgcgccagggcaggatcatcctggtcacggatgatgaggaccgggaaaatgaaggcgattttatctgcgccgcccagtatgccaccacggagaatgtcaacttcatggcagtccacggcaaaggtcttatctgcatgcccatgagccgggagctttgccagaagcttaaattcccgcagatggtagcggacaacggcgataaccatgaaactgcatttacggtatccgtggaccatataagcacggccaccggcatttctgcacaggaacgcgggaccacggcccgttcctgcgcggatgagggtgcaaagcccggggatttccgccgtccaggccatatgtttcccctgatggcaaaggaaaacggcgtcctggagcgtcccggccacacagaggccaccgtggacctgatgcgactggccggactgaaggaatgcggcctatgctgtgaaatcatgaaggaggacggtaccatgatgcgcacaccgcagctcatggaactggccggacactgggggcttgccatcaccaccataaaagccatccaggattaccgcaagcagcatgactgcctggtggaacgcgcggcctgcaccaggatgcctacccggtacgggaccttccgcgcttacggctacgtggacaagctaagcggcgagcaccatgttgccctggtaaagggagacatcggggacggcagggatcttctatgccgtgtacactccgaatgcctgacaggcgatgggttcggctccctgcgctgtgactgcgggcagcagtttgccgccgccatgggacagattgaaaaggaagggcgcggcatcctgctctacatgcgccaggagggacggggcattggcctgattaacaagctgaaggcatatgagcttcaggaccatgggatggataccttggaagccaacctggccctgggatttaaaggggatatgcgggagtatcatatcggcgcccagatactcaaggacctgggcgccaggaccctgcggctgctgaccaacaacccggacaaggtataccagctctccgggttcggattggagatcataaaacgtgtccccatccagatggaacccactggccatgaccttttttacctgaaaacaaaacagcagaggatgggacacatcctgcactacgaaaggaatacaatataaggaggatccgttatgaatatatatgaaggaaaactgataccggacaacatgaaggtgggcattgtagccgcccgtttcaacgaattcatcacctccaggctcttaagcggcgccctggacggattaaggcgccatgacgtggaggacgggaatattgacgttgcatgggtgcccggagcttttgagattccgctggcagctttaaggatggcttccagcggcagatatgacgccgtcatctgccttggggccgtcatccgcggcagcacaagccactatgactatgtgtgcagtgaggtttccaagggaattgcccatgtatcccttacaagcgggattcctgtcatgttcggcgtgctgaccacggaaaatatcgaacaggccattgaacgcgcaggctccaaggccggcaacaagggctatgagtgcgccatgggagccattgagatggcaaacctgatgcgtgggatgggtgcatctggcgggaatgcatttccaggcacgccctaacgcgcggcgccggccctcctgattccccacacggacaccaggcaggccaatgcctcagccagcacaaacgcaagccacaccccgtccatcccccatatgccaggcagcaggaacgcaagggggatgatggccaggcagcccctgacaatggatatggcgaatgctttcccggtttcggtcacagcacttaaaaaagccgcgctgacaatgttaatccctgcaaagaggaatcctgcaaaatacagctggattccccgccttgcaatgggcaccagctcctggctgccttcgctgttgaatatggcgatgattccctgccaccatgaattggcgcaggcatagataccggccgccagcacaatggaaaggatggccccataccggaacacaagctttaacgtctttccatcccccgccccgtaactgcggcttgccaggggctgcatcccctgggcaatccctgtgaatacagcggtcaccaccagcgccaggtttgccacgatgccgtaggccgccaccccggtattgcctgccagggacaggatgatgaggttaaacatcatgagcacgatgccggatgacaattccgttataaaggaggacacgcccggtgacaggatggatacggcttccctcaggctccacctgcaccttacgatggacagggagctttttttcccggacagatgcagggcaagcacccccatgctgatgacaggagcaagcccggtcgcaaaggccgctccggacatccccatggaaaagggaaacatgaacaggtaatccagggcaatattggccaggcttcccgtcagcatggctgccatggacagctttgggttcccgtcattgcggacaaaggccagcagggtattgttcatgatgaaacagggggcaaagcagaggatgaccctcaggtagaccaccgtattgtccatggtgtccccgtccgcccccaggacagccgcaaggacgggcgcgcacaaaagaccggctaaaaggaacacgcctcccgctgccagcgccagtcccacggtccttgtgaatacctgccccgcctccctttcatgcccctggaacctgaagatggaaaaccgggtgcctcctccggcgcccatcataagtccggtggcattgattacactgtacacggaaatagccaggttaagggctgccaggccgctggttcccagggccttggatacaaaatacgtatcggccaggatataacatgacagcccgatcatccccatcacgttgagtcccacatatctgaaaaattcataagctccgctgttttttcccatccctgtcctccctatgcagccggcggaaagcaattttcaaacacgattcagtgccgccggctggattttcccgaaaaaaagcccggacacattccttctttgacctaacggaatgtgttcaggcacataagcgctgcatacccggtggcaggcagctgtgtttacttattcatatcttgataaagtctatcatgattctgtgatattttcaaggactatagaaaccattctgcccccagtcctgtcacagtgaagaacgtcagtatgtacaggcagatggatgtaatataggcaaatggaattgaaagcttcaggaaatccctggactctacttttgtataagccagcccccatgcaacccatgactgtgtgatgcaggaacccacattcaccgttatggctggaattgcaaatacacagaataggaatgggacagaaaagcttgccacatgggacagaacccccagggttgccgcgccacatccaaacagtgtgagaggcccccggaaaaaagcaaatgctgtcagcaatgcaaaaacaacacacacaaccagctcgctccttggcatgatggaaccgattatcacattaaaataaggggatgcataggccgcgcaggcgttaaacataggcagggtcagaagaaaacctaccagcggagccgtgtccaccacaccatcgtagtataatttattgaccagctgacagttttccttaaacgtccctttcatcctgccgcaaagaaacaatgctgcaaagccggcaataatgaatcctccgataacagaaaaatccagccatatcttaaggaccactggtacgataggcagaatcagggcatatatgggggcatccttctgggcaggaacactggtgcgtgcagcccaggcatgactgactttgcgttttctcaaatagaatgcggtaagcaggttaaccacaaccagggtgattaccagcgccatatacccaaaatgcgccgcgtaccatccaaaggaaaaggcaggcattccatccaccgataccacaaatgcccgaagctgtgcgtgcagcacaggattcagatacataccagcggacacggatgccataaatgtgaacatggcaattcctttaggtattccaagtgataaaaggataggaagaacaataacaccgattgcaatcacaggaccggcccccatcatggctgtaaagataaatgcagtggcaatatttaggagcaggatggtgatgaccggcctgtcaccccctaactccactactttgcggatgattgtggaagcaatgcccgtgtccatcagcacccggccaaaccaagctccccagcacacattcaccagtgtaatcccccagttttccgatgccgactggaaaattttatttaaaattcccaccaggggtgtcccggttcctttgccaaactgcagaatgctgttatccgccaggaactgaggcgataaaaagaaggtgccacccaatgataatacggtccataataccgtcatcactaaaaaaccaatcaataaattatagccttttacacaataatatgccaatccgaaaaatgataaaatcagaataatgccaattacatactccataccgattaacctccatttcaaatgacgaatcatccttaaatatcattacaatatcccgaatatccggaaagcctctgttgcgcccataccattttcaatggctttccttacctccttttccccggctgctttttcaagtgccttttcaatgcattcccctgcaattgcctttggaatgataagcaccccgtccacatcgccaaataccagatccccgtcatgtatgatgacactgccaatttcgatggtacacctgaaatcaataacattggtgcgtatactggagtcctgtgcccagcagccagcagaaaaaacagggaattgctggtccagtacctgaggcgtgtcccgggtatagccgttcagaaccgctccaaccgccccccgcatcttcgctgcagcggtcaacagttctccccacatagcgctgttatgcgccccggtagcaagatagacctcattctgatccaactgatccaaagcctccgtcagcaggccaaacggcttttcctgtgcttcaaatacatcacactccaaaacagtgcatgcctttcccgcaatcttcatcccttcctttaacggccggattcctgccggcaggaactggtgggaataccccatgacatccagtatgtcccccaccaccggcgtatacagcctctccctcataagggaaaacatctcctcttcacttttccacatggcttctcctccttagctggattttacatcgttaactccatatacggtcatgggcccattcatggttccattcctctgtactctcccataccccaggccgtttgggattgatatgttcagccagtacctcatcgtccagttcctctattccaagtcccggacggtccgtaagttccagccagccgttctgtacgattggcctgctgcttccctttaccatgctgtcccaccatgctacatcgtgggcatggtattccatggccagcagattatctcctgccgccgtacagacatgtgcggcggccatacagcccacgggagtctccgccatatgcactgccgccgcgattcccttttcctccgccatttcaataatcctcatggactcaccaatccccccggctgtcagtacatccggatgaatgacggaaactgcccggttctcaatcaggggccggaatgcatcccttccgaagatatcctctcccgtacacataggaaccgtggtgctgtcacttaacaccttccactggtccgtatagaaccagggcacacaatcctccatccaaaaaatattaaatttttccagcctttttgccagcttcagacatgactggtaattcacatgaccaatgtggtcgattgccagcggcacatcataaccaaccatgtccctggcctgtttcacgtaatcctccagatagtccagccccagttctgtaatggaaaggcccgtaaaaggatgctgtgtattcatgaagtctgtaacgtttttatctgtaattccaaaggatagctcctcccgattatgtttcctcatctgttccacataccccagcggtgcatttaatgctccgtccacatctaccagaagatccacgcccagatccattttcaacatggtataaccgctttccatcctgcttttaagtgcaagtcccatgtcccgccctgtatgctttccgcttacatccgtatcacaatagaccctcaccttatcccggcattttccacctaacatctgatagaccggtaccccatatgcttttccagccaaatcccacaatgccgtttcaatcccgctcacacctcctccctggcgggcatgacctccaaattgacgtatcttatggaatatcttattgatatagcaaggattctcccctaaaataagacgcttcagttccaacgcatagaaacggttggaaaaatcccggatttccccatatccgctgattccctgattggtatcaatccgaaggaccgtgcagtccatgggcgcccccacaatatccgtgaacctcatatcagtaatcctaagtccggacggataggatgctgtctttatatttgcttcacatgtctgcacgttacatgacccccttccagtatttcaatatttttttgttcacaacattatccggtatgattccttctgaaagtttctttacgccatccagacattccccagccatatgaatacgtgcatcccatgtctcgctggccacatggggcgtcagtatgacctgttccattccttcaagttccccgcccgcatagggttctgtctcgaatacatccaatgccgctccttttagccgacctgtcttaagggcgtctgccagcgccttcagatccaccagcgctcccctggatgcattgacaaaataagaaccggttttcataagggcaaaagcggatgcgccaaacatatgacggttttctcctgtatagggaacatgcagggaaatacagtcgctttcttttatcacctcctccagcgtcccataccggaacccctccttctcctctatttccgtggaaagccgcacggggtcatagtaggacacatccatgccaagtgcagccgccttccttcccacacaccgtccaatccgccccatcccgataatgcccagcacatggcctgccacggaagtctgggttgtcccaaaaggctctgtggaccagactcccctctttatctgggccgtatagcggtacaggttatggaaaatccccataatcaaggcaaccgtatgctccgctgttggatccgatacctgtgtagggctgttaatgacaggcaatcctaaacagtccgcatggcccatgtccacatggtcgaaccccactcccagactagcaatcattttcaggcatttcccggcgtccattataggacgtgtgacgggcatgcctgcaatagaaaacaggacctccgcctgcgcaatcattcccatcagctcggtctggctaaaacttcccttcatcctgtccggccggataaactcaaacacatcctcatattcctgaacacactcatccggaatccatttcgtacataataccttcaacatgtccatcctctctttcctgcattctacatctcatatcccatatggaaaaaataacacatatatccaggtaataacatggattttattgcaatatatggacaaaatcgtactaatatttcaccccggctatttccattacaggtcacggcaggtataatgaagatactggtccatacgtcattatttcccacaggaggcagccatgctggagttacagccattcatccattcaaaaaatctgattttggtcccttatcttggaaacatcagccgccgtaaacaattctccggatggtaccgcggaaaagttgtccaggaggaccggcatgagttttatctgattacccgcggacagggcacattaaccgtcggcgaacagtcctattccgtgacagagggtaatctgatttacattccatcggttgcaggcacccgctataacctgattcccggggaagggcttatagactactattccatcaacctgcgctgcgccatggctgtccacaaaaatgaggtgtggctttataatgaaaatacacggtaccattatcagtccgttccttacccggaaaacgaagagtggtcgtttgagcgctgcagcggccccatggacctgccggtggtccgcgccatgtccaactacaccctattacgtgaattactatccaggatttaccacatccggactgatacggactccatcaacttctgggctgaaaaaaatatactacagcagtttttctgtgaagtcgcactccagaataaaaaagccggtcaggaggatatgaacacgcgcaggctcaacaaaatcatccactacataaaaaagtactacatggagcccattaccctggacagcctatgcagtactgtaaatctcagtcccagttatgtcatcaaactttttaaccactatacctcactgtcccccatggcctacgttaaccgtgtaagaatagaagctgccagggaaatgctggcagagacacccctgtccgtttcggatatcgcagcacagacaggtttcaaggacagtttttacttttcaaaaaaattcaaggcagtcaccggaatcactccacggcagtatcggaacagccttccctaaatccggcgccaccaaatagtcaagagggattttcatttttttatggaaaacatgcaggatcatcctgatatggttcttataaatgccggaaatgccgggtgcacatccgtttcatgctgccgcaatatgaaagggacctgcatcagcaagtcccaatggcatcaaccagttcgtcaaattgtcgaactggttttttgcatcaaaaaaaagcgcagagatacccctgtatttcaacactaactttaaaaaatatatgaaatatatgtttctatactacttctgcattctgctaccgttgcgtagtaaggtatccgggaccattatagagtttcttgattggaggattgcgtctgccatcaactctaaactttgctgttggtatccaggtcatccaacgcccccatctgcgataatgccttccaggtcggactggcacttttgttttagcaaaatctctgactaaactcgaaaggtattctgctggcataatctcacgctcatacatcttgaaatctgacagcagctttagaaaccggtgttctgcccgaagggtatctgttatgttcttcatgttgggaatatattcatatttgttggatggttctcttatgtgactgttttctttactatcttcacatgctgcttcataaaacaaaccgcaaactgagaaacaaagtatttttccataaatctcatttataacgatattatattttgtggaattaaaacgttcggcttccagatggtttttgatatcaaagtatacggtttcattatcccaacgctgtacatgataaagctctaagatacgttctgttgaaaatgagttagattccaggttcgtaaaataaatagagtctgtaacggtcgggggggtagtggttttgccatcagtcaatgtatactcatacgtattcctgatcacgcgaagtgataaagccccaacacgctccgcataagccctgttatcctcatatttcaaacgtttgatccatgcccgattaaaggggacttcgatgattccgtctctttcaatgctgttgacatactctttgtagaaatttgttttgcctcgcacaataaacttgtaatctttcagggcattatagaggaataaatcagcagaaccgtaatagcggtcacaaagcagaatgattttctttccctgaagaacctcctcgcaattctttaaatgttcaaatagcattgggagctcggaggttttgtatggcgctatgacagaatcaaggattacatgatttaaaacatcaaccagaatcgaacactttgcctgtggtttctttacctggctattatcttttatgtacatgtttgttaccccaccataataccctcttaattctgatgaattgggcaggtcaagtaccgagccatcacaggcaagtatcagataatcatccagtgtatgatattcctgatgcatatagaattctttggcaaaagagtgtatgataaagggaaacacatcgggattaagtttgtttagagccttaaacatagcctgttttgaaacgttcggtttttcaagctttgaaaagtaaagagccatgtccttgtttgtggtttcggcagaccgaaatacatagaaaagaagtacatcgcgcaaggatatctttcttgactgtgtaaatcctcgtatggttgttcttgcagcgctggcggtatcgggagaactgagaagccaatcaagtgcctccagcgcacgcttgatgtctatcatttctatactacgccccctcgtcatcataaatcagacgaggtttcttttttgcatacatagctttcagatacggcacctgctcattctcaagaaggccgaaattcttaagagtgcggtgtttaatcttgccatgatcgcggtaggattccacaaggtagcagaagcaggtattttgattgcccttgacattaggtacaactttaataaacatataagtctcctttctatactacaaatatacattaaaatacttattttatcaacttttaacaaaaagcactatactacatttcgacataaacaaaagtcctgacccccaaaatggatcaggacttttgtttattttttataactggttgatgccattgggacctgcatcagcaagtccctttcttcatggttcccatgtctatatatactttttaagttcatccaaaaccacctttatatccaacggcttgaccagatatcctgtcatccccgcctccatggctgccatcctgtcttcctcaaatgcattggcagtcatggccagaatcggaatctgccctgcatccccgcgttccagtccgcggatggaccgggttgcctccatgccgttcatgacaggcatccggatatccataagtactgcctggtaatgatccggggcgttatcccgaaacagggcaactgcctcctggccgtcccgggcagcctccacctccatgccatacatctccagcaaggtcttggcaatctcccggttcagctcgttatcctccgccagcaggatacggcagtgatggaaatccgtcttttccacccgttcctcctcaggatggctccgcctcacggctcctgcaaatgcatcaaacagggaattcctgaacagcggctttggtacgaaacaatccaccccggccttcctggcgtcctcctctatgaagctccagtcataggccgatatcatgatgatcgtggtatcaggtcccaccagcctgcggatgcgtctggcggtctccacaccgtccatatccggcatctgccagtcaatcagggcaatatcatagtacctgccatgcctgagctggcgttccacttcctccaccgccttaaagcccgagtccacccagacagaattagctccggcgtcctttaggatttcggtacactggcaccccaccaccgggtcatcatccgccaccaggacggccagaccgtttaacagttcctgctgcttcctctgcctctccttctgctcatcgtcctccaccaacttaaggggaatggtcactgtaaatgcagcccccttgttcttctcactctccacttcaatagtcccgcccataagctgcaccaggttatagacaatggacagccccaggccgcttcccacattattgcgggcagcctccggggactcctgctcaaatggctggaagatacggctgcggaactcctttgacataccgattcccgaatccctgacacagaaccggatataggaaaatccattggtgcgcttctgttcctggatattaatctgtatcagtccgtcggccgaagtgaatttaagcgcattggacaggaggtttaagaggatctgcttgaccctcagggaatcacccacatagtactgttccaggggttcctcatggtaaatctcgtaccggattttcttttcctgcgcctgcgggtagacaatctggtcaatctcccctatcagttcggcaaaatcaaaatattcctgggacagttccatcttccctgtctctatcttggacatatccagtatgtcgttaatcagggacagcaggtacctggaggaagcgtcaatcttccggaaacaatcctgcacgctcctatcgtcccccagcttcagctggccgatggtgctcatgccgatgatggcgttcatgggcgtgcggatatcatggctcatcctggaaaggaaatcggatttggccctgttggcagccttggccgatgcaagagcgtccctgagaagctgctcctggcgggcctgttccgccctctgggcatccaggaccttgaccaggataatggcaagcatgtcaccattaaacgggttctccacatagatgatctgcagggaaatccagtggtattcatcgtccttcccaatctgccggaactccatatagatttcccgttccccggccgcaaagcgctccatcacatgttcccgcttaaaatggctgatataatcttcctgataagcaggatatacaaggggacagaaatattcaagcatcccggagtagctgccctggcgcttaccggcataaagctcctgcccttcgatgaagcagttaaatgtatcccttgtgaggttcacgctcatgatcagggggtatgcggtacagatggctgcctgcagggacctgttctcaatcatctgctggcgttcctgttccagctccatgcgcctgagttcagtgatatccgtaaatacggcctgtatcacttccagaccgtccgcattgacaatccttcccataaccacgctgatccatatctgcctgccatccctgcggaccccctggcgtatataggccaccgtgtccccgtccagcacaaggccgtccaccaggtcctcaatccatttcctgtcctggtccgataccaggtcatagggacttctgatgacggaacggtattccgcctctgatccgaacccgtatgcttcccacaccatccggttcacattgatgatcctgtgttccgggtccgtggaaaactgcaggatcccgcatggcaccgagttatacagctgcgacaggaaatccgcctgctgcttatactcctgctcctttttctccagaactgactccagtctctgatatgcctgcgtggcggcctccagggggaacagctccccctcctgtatatccttaaaaggcgctgaattatgtatgtggattgtcttaagcccatcctcatgttcctggaagataaaggtaatcctttgatggatattcaggaatatcccggttccagccttggagcggagcatgctcatcccctcgcacaggtaattgccgccccccagattcctggtttcatagacttcgtcaaacatgtcacatggcgataattcatcctttccagccctaaagcaggcagccacagcttccttcccctctgccttctgcctctccccggccccaagccatacaatatcatctgtaaatgtggatataaggaattccacatcacaatcgcagaaatacctggtcaggatcttcctggcaaatccctctatttcttccttagacctattacccatactctcttttaaacctcataataaaagcctcccggctgatttccgtgtgaaccgctcatctataccataactaatccagtataacatttcagcaggccaaacgcaacgcgcagggaggcagataatcttatattttcaactttttctaacttatccggctctgtcaggacagtttcttcatgacaattccactattttccaaagatgccctcacatcaatgatacgctggttggaggaaccgcggaaaggaaggctgatatccttcaacccttccacaaacctaccgtccaccagcacatcgatcatgcccagcatcctgtccgtaacctcacacctggcccggctctcttccagaagttccttatccatgagatatcctgtataacaccagatatccttctcaggaaaacgctcccttacccgtttcagaaacggcagcagcgtcctctggttctccggctcaaaaggctcgccgcccaaaagcgtcaggccgttaatataatccggtgacagggcgtccagtatctcctcctctgtctcaggagtaaagggatttccgtatgaaaaatcccaagcctcctcattaaaacagttcctgcaatggtgtgtgcatcctgacacaaacagggataccctgacgccctccccgttggcgatatcattttttttgattgtcccgtaattcatattataaatgcagcaccctttcctttatctcctgggtccttccctggttccagaactgggttccgatataaccgcaggtcctgcgggccacattcagcttgttctcatcccggttgccgcacttggggcattcccataccagcttgccgctgtcatcgttcacaatacggatttccccgtcaaagccgcattcctggcagaaatcgctttttgtattcagttccgcatacatgatattgtcataaatgtagcggatcagctgaagcacggccggaatattattctgcatgttggggacctccacatagctgatggcgccgcctgtggaaagggcctggaactgggattcgaatttcagctttgcaaatgcgtcaatctcctctgacacattcacgtgatagctgttggtgatatagctcctgtccgtcactccctcaatgatgccaaaacgcttctggaggcattttgcaaacttgtaggtggtgctttcaatgggtgaaccgtagatgctgaacccgatattggtttcatctttccagcggttgcaggctttgttcatatactccatgacctccagggcaaacggcgttgcctccgggtcggtgtgggacttgcctgtcatatacttcacgcactcatagaggcccgcatatccaagggagatggtggaatacccgccgtacagcagcctgtcaatggtctcccccttcttaagccgcgccagcgcgccgttctgccagaggataggcgccgcatctgaaagcgtgcccttcagacggttatggcggcacatcagcgcgcggtagcaaagatccaggcgctcatcgaatatgttccagaacgcatccatgtccccgccggaagacagcgccacatccaccaggttgatggtgaccacgccctggttgaaacggccgtagaacttataattgccatcctcatccttccaggggcttaaggcactgcggcatcccatgacagggaagcagttgccttccttcagttccatcatctttttctcggaaatgtagtcgggaaccagacgctttgcagtacatctggcagccatttccgtcaggtaatagtactcggtgccctcagtgatgttatcctcctccagcacgtaaatcagcttggggaacgcgggcgtgatccacacccctgattcattcttaacgccctggtagcgctgctttaaggactcctcgatgatcagggccaggtcctttttctccctctcgttcttcgcttcattcaggtacatgaacacagtcaggaaaggcgcctgtccattggtggtcatcagggttatgacctggtactggatggtctgcacgcccttgattacctctttgcgcagccggttctccaccacctggcggatggcttcctcggaaggggtgcagccgaatgtcttaacctcctccagtacctccgcatgtattttctttctggatacgtccacaaaaggagccagatgtgccaggctgatactctgtccgccgtactggttactggctacctgggcaatgatctgggtggcaatattacaggccgtggaaaagctgtggggcttctcaatcctggtctcgctgatgaccgtgccgttcataagcatgtcctccaggtttaccaggtcgcagttatgcatgtgctgggcaaaataatcggaatcatggaaatgtatgattccctccttgtccgcctccacaatatcctggggaagaagcatcctcttggtcaggtccttgctgacctcgcccgccatataatccctctgcacgctgttgaccgtcgggttcttgttggaattttcctgcttcacatcctcattattgcactcaatcagggaaaggatacggttgtccgtggtgttggccttacggataagggagcgctggaagcggtaccttacataatccttcgccagctcaaaagcgcctgtggacatgatctggttctccaccatgtcctggatttcctccactgatactgcacggttcagcttatcacatttgtactccacataatccgcaatgtccttgatctgttccatgctcagcttgctcttgcccgctgccacgttggccttggagacagccaccacaatcttatttatgtcaaaatcttcctccgcgccattcctcttgataatcttcattgtcactacactccttttatccgtctactctcatacgccgccgcgtcccccgcggtccggtgtatctgtatcctatcatataatcctggaaaaatctgttgcttgtgcaacagtatatgattttagcactaaatgttgtgtttttcaaggggaatatatacgataggatgtatttcagtaaaacgcttgaaaggcgtggattttagtaatgccagttcatcattgtgctgatttcctaatccaggtaggctcccaccggggaggtattatactgcttcagtatctcaatcaatacggacccgtccggctccactgtctcggaaagtatcttgtactgggtccggttccggtccagctgcatcttgtatttgtccacttcctctttgaccagcttcaccgccaggtcgctgcttacatcctccttcagcataaaatgcagggtctgtctgatacatgccgctttgattcttttcattccttacaccttcctaatcataattttatatcaatgccaaaagcaccaataccgtcttatacggcaactaaaaaaggcccttctcactcagcgaatttgagcgaaacaggccttcttccgtttacccgaaaattaccagtggagattatccatatagatgaaaaatcctctgaaatcttatgttttccggtattgattatatcatatttcccgaatcttcgtaagtaaaattttccagttcctgcacactttccttacatatggtccttatctgccggcccttgcgcagctcccccgctccaccatatgatggggcacgatgatcttcgttgcaaccagttccggattctccacatggctgatcatctgggccgctgcctctatccccagctggatggaattcacatccacggatgtgaggggcggggtggtgaacctggaaagcagggagttattaaaggaaatgatggagatgtcctcaggtatggacagccccagtccgatacatgccttttcaagggccactgccagtatgtcatcactgaccaggacagcagtggggcggtcctctctggtaagcagggccatcagcacctggttctggtcttccggcacagccggcgcctccacacacagcccgggccgaaagggaatctgatgttccgtcagggccagcatataccccatcttcctgtcattgttaaacagcagggagtggtcgcctgacagataggcaatcctctcatggcccaggcttaacaggtaagccgccgcctccctgcctgcaagcacattgtcattatccacatagatggtctggttcacattcctgtacgcctttccaatcagcacatataacagcccttcctcgtacaggtagtccaggaccgggtcctgctccttggaatacagtacaataaatccttccgccagcccggtccttgccatattctttatgacctgaagtatctcatcctcgttctggcccgtgattaccgtattgatatactgtttctgattacagtactggctgatgcccctgatcacttccagataaaacgcattctggtatgcctcccactgggatggcggcagaatgatcccaatggtcctggaattctgggtagccaggctgctggcctggaaattaggctcataccccagttttgccatggcctgccgtaccttctccttggtctggcggctgatggacggatggtccttgcaggtgcggctcacggttgacggggatactccggcaagggcggcaacatctttaattgtaacaggcataacgcgcctccttaatcatcagattcacttgaggattcaatcactcttcctatattgtaatattcaatgcaacttttgtcaaactttttcgtattgtttgcgtaaattccaatcctataattgcatgaatttacactgaaatcttgcacaaaaccccattgccatttttgtgcaaaaggtagaaagaactgttttttcataaatgatgcttgcattccatccgcaaacgggctatatttaacgcaagcggttgcgtaatttaatgcaactattcgcgtaacataatttcaggaggtcaggtcacatatgaacaaaaaagacgacggctgtatcggcatcaggattttgtctcccttaacagggacagcagtagcattagaggaagtaccggatccggtattttcccagaagatcattggggatgggattgccatcatcccacaggacgggaaactggtaagccccattgacggtgaggttgtatccgtggcagaaacccttcatgcctatgggctgcgctcagaggacgggattgaggtcatggtgcacttcggcctggagaccgtggcattaaaaggggaatattttacatgccatgtaaaacagggggataaggtaaaagcaggggacctgctggcagaagccgacctaaaggggctggaggaaaagcaggtcagcctcatcactcccgtactcatctgcggcggtatggaaaaccgcaccatgagcacggtcaccggccctgtatccgctggcagggataccgtaatcacgctgctggataagtgtccgccggatgacgcccctgcccctggacctgaaaagaaaaaatccaggtcccccattaactttgatttccttcagaagcttggcaaggtcctgatgaccgtaatcgcggtcatgcccgcagccggactcatgatcagcgtggggaagctggtacagatggccggaggggacatgaattttgtccttaccctgggaaggaccatggaaaccatcggatgggccatcatcaataacctgcacatcctctttgccgtggccatcggcggttcctgggcaaaggaacgtgccggaggcgcatttgcagccgtgattgcatttgtccttatcaatgtcatcaccggagccctgttcggtgtcagcagcgctgacataagtaatcctgaggccgtcacccgcacccttctcggacaggagatcctggtaaatggatacttcacctcagtccttggcgctcctgcccttaatatgggcgtgttcgtgggtatcatatccggatttgcaggcggggtcatctataacaaatattacaactacagaaaactgccggatgcattggcattctttaacggcaagcgtttcgttcccatggtggtcattgcatggtccgtcgtcatttccctggtgctggccattgtgtggccggtggtgcagaccgggattaattccttcggcgtgtggatagctaattcctctgccacctcccccatactggcgccctttatatacgggaccctggaacgtctcctcttgccctttggcctccatcatatgctgaccataccgatgaactacacttcctttgggggaacttacaccatccttaccggggtcaacgcaggctcacaggtatttggccaggatcccctgtggcttgcatgggccactgacctgattaacctgcagaacgccggggatatcgccggataccagaacctgctcaccaccatcacccctgcccgctttaaggtgggacagatgattggcgcaaccggactgcttcttggtattgcgctggcaatgtaccgccgcgtggacgtggataaacgcagtaaataccgctccatgtttgtttccaccgtactggccgtattcctgaccggtgtgacggaaccgctggaattcatgttcatgttctgcgcactgccactatatctggtatatgccgtgcttcagggatgtgcatttgccatggccggtatcatccatctgcgtctgcattcctttggaaacctggagttcctgacccgtatccccatgtccctgaaagccggactgggaggcgatatcattaacttcatcatctgtgtcgcggttttctttgccgttggatacgccattgcctatttcatgattggcaggttccattttgccaccccgggacggctgggcaactacacggatgataacgggtccggggacagccaggacgcgcctgaaaagcagatttccggcaaccgtcaggctgagcgcatcatcacgctgttgggcggcagggataatatcctgctggtggacgcatgcatgacccggctgcgcgttacggtaaaggatatcacaaaggtggctgaactggctgactggaaggcggaaggggccatgggcctaatcaagaaagaccagggcatccaggccgtatacggcccgaaggcagatgtactgaagtccgatattaatgatatactgtaaaacagagccggagcggaatatccagcagcccacaggaaggagtaccatgaaactgatgacattaaacacccacagccttgaggaagaaaactacgaggccaagcttcacgcctttgccgaaggcgtctgcagggctgagccggatatcatagcgcttcaggaagtcaatcagacccagacctctgccccggtggacaaaaaggatctggaactgtatgggtatgtgccatgtgctccttgtactccatatgccccccatgcgcaatgtgcgtccgtctccccatgcagcgttcatccctcccccatcccccgcacggataaccacgcataccgcgcagccaggatctgcgcggagcacggcaggccctaccattggacctggattggggctaagaccggatacggtaaatacgatgagggcctggccatcttaagccggattcccattgcggaaacaaagcagttttatatcacagcctcacaggactatgccaactggaagacacgcaagatcttagggatagggattgccgcggaacatggcatggaatatttttacagcgtccatatgggatggtggaaggatgaagacgaaccatttgaaggacagtgggaacggatccgaagggagctgggggatggggcgtgtctggaaacataccctggccctgtatctggccctgtgtggctcatgggcgatttcaactcccctgcccatgtacggggcgagggcagggacctgatacgcggctccggatggctggacagctacgaactggccggcagcagagacagcgggatcacggtgggccatgccattgacggctggagggaacaggaggatgtttccggtatgcgcattgattatatctggaccagccgcaaggtcccggtccggtcctcccgcgtcatatttaacggctcctatgagccaatcgtgtcggaccactatggaatcatcgtggaatatgaaccagggcatcattgcccatgaaaaggagtatatagaaaatgaaacgagaaagcggaatcttactgtccattgccagcctgccttccagatatggaatcggctgtttctcaaaggaagcctacgaattcgtggaccagctgaaacaggccggccagtcctgctggcagatccttcccctgggtcccacaagctatggcgattccccctaccagtccttttccacctttgccgggaatccatatttcatcagcctggaggatttgattgaggaaggggtgctgaccagaaaggaatgtgaaagcgctgactttggggcgcatcccggggccgtggactatgcaaagatatataaggaacgtttccccctcctgcgccttgcctatgagcgcagcaacatcagccaggatgaggaatttaaacagttttcagccgataataagtggtggcttgaagactacgccctgttcatggccgtaaaatccagatttgacggaaaaccatggacacagtgggcagaggatatccgcctgcgctggcagaatgccctggactactaccggagggaactgtattatgacattgagttccatgaatatctccagtttaaattcatccggcaatggaataagctaaaatcctatgccaaccataacggcatccgcattgtaggcgacatccccatctatgtggccatggacagcgccgatgcctgggcgcatcctgaactgtttgagctggaccgggacaatgtccccactgctgttgccggctgtccgccggacggcttctcctccacgggccagctctggggcaatccgctttaccgctgggactatcacaggcagaccggataccagtggtggatcagccgcctgtcctactgctataggctgtatgatgtggtgaggattgaccatttccgtggatttgacgaatactactccatcccggcaggctctgacacagccatcgggggccactgggaacaggggcctggcatcgggttcttccatgcagtaaaacaggccctgggcgaaaaggaaatcattgccgaggaccttgggtatgtgacggactcggtccgccaattggttaaggactgttccttccctggcatgaaggtgctggaatttgcctttgactccagggattcaggctgcgccagcgattatctgccccacaactatcctgaaaactgtgtggcctacacaggtacccatgacaatgaaaccatcacggggtggtttaactccatcacgcccgcggagcaaacgcttgccagggactatctgtgcgattcccatacgccggaaaacagattatatctgtccttcatcagcctgatcatgcgcagccaggcccggctgtgcatcatcccccttcaggactacatgggactggacaatgactgccgcgtcaacactccctccacggtaggcgcaaactggaaatggaggctcctccccggccaggtcacaaaggaactgcttcagaccatcggggctgtcacgctacggtacgggcgctggaactggtaaggacatgggagggatatcccccatccttttttatccccgccatatcagacgcggatttccgttcccgtcagcttctcataatatcttgcaatggcgctgtggtcattctcccccagtccgtccgcgtgcaggttctgcatcatctccatcacctgggaggttaggggaaggggggcgccgactccgtggccggtttccagggcattgcccagatccttgatatggaggtcaatcttgaatcccggtatgaaattgccgtccgtaatcatgggaactttggcattcatgaccgtggaaccggccagcccgcctttgatggcctcaaataccttaaccgggtccacaccggccctggtactcagcatgaatgcctcggatacagccgcaatgttaagggccacgattacctggttcgccagcttggtggtattccctgcgccgatatccccgcagtggaccgcactggcccccatggtcatgagcacgtcatagacctggtcaaatacctctttatcaccgcccgccatgatggacagggttccgtccacagcctttggttcccctcccgacaccggcgcatctatcatccttatgcccttttttgcacattcccggcatatttcctgggaagccaggggcgcgatggaactcatgtcaaccaggatggttcccggaacagcgccttcaaggaccccgtccgttcccagcaccacgctctttacatggggtgaattgggcagcatggtgatgaccaggccgcaccgggcggctgcgtcctttgaggaggaagccgccttcgcgccgtcctttaccacctcatccatgttggattccaccacatcgtatacgattaattcatgtcctgcctttaacaggttcctgaccatgggttttcccatgattcccaaaccgataaatccgattttcatcgtcctttgctcctctctcttttcctaaccgcttattattcctaaccgcttatatatccgccgtctttggccgcctatatgcctgccatctccctgaccgcctctgcaatggctgactttgtcagcccatggtactccagtacctcctggtaattgtgtccgctgcacccgaaggtatcctggattcccaccattttcatgggttttggctccccgcagaggacttctgccagtgcgcttccaaggccgccccttacattatgttcctctgccgtcaccactgccctgcagccttccgccatcttcctcacggcctcagcgtccatgggcttgatggtggacacgttgatgaccctgacggaaacagcgccttccagttcctctgcagcctccatggccagccccaccatgtatcctgtggcaaacagggccacatccgtcccttcctttaatacggttggcacgccgatggtgaatttctccccttcctttgtcacattgggatagtcattccggttcaggcgcagataacatgggccgtccatggcagccatggcctttaccgcctccactgtctcattggcgtcagccggacagatgaccgtcatgttgggcactgcccggaagactgccaaatcctccacacactggtgggtcgcgccgtccccaaaatccgataaaccggaggaggagccgcagattttcacattcagtttcccgattgcaatggtctggcgtatctggtcataggcgcgccctcctgcaaacactgcaaaggaattggtaaacgggattttccctgtctgcgccagtcctgccgccacactggtcatgttggcctccgcaatccccatctcaaagtgtctctggggaaattccgcctcaaacagcttccccatggtggaggcgcccaggtccgcgtccagcaccacgatccgctcatcctgccttcccagttccactaatgtattgccatatgcaattctctgatttgtatagcccatgtctatgcctcctgttcctgtgcggataattccaaaagcgcctgtctgtaagtttcctctgtcagcataccgttgtggtatcccaccacgttttccgcaaagctgacgccctttcccttgaccgtgttggctatgatggccgtcggcacccccttcacggtttccgcctcgtccagggcactgagaatttccctcatgtcatgtccgttgatttcaatcacatgccagccaaaactcaagaatttggccatgatatcccctgtgtcaaaccgctccttcgtccttccgttggcctgaagccggttcctgtccacaatggccaccaggttatcggccttaaatgcgctggccgccatggccgcttcccatatctggccttcggcaatctccccgtccccaaccagcacatacgtcctgctgtccaagcggtccagcttaaggcccagggccatgccaaggccaatggaaagcccctgccccagggaaccggttccggcctcgatgcccggggttttctgcacatccggatgtccctgcaggtaggagccgatttccttggtatgctttaaatcctccaccggaaaatacccgcactccgccaatgccgcatactgcaggattcccacatgtcccttgctgagcaggaaccggtccctttccctccacttcggatgtttggggtcgtgtctcattttatggaaatacagcgcggccacaatgtccgcagaggagttggaacctccgatatgtccagccactcccacgccgatgctgattaccacgtcccttctcagcttctgcgccttgtcctctaaatcctttatcagtttatcatcatattccatcacagattcctcctaatccaccattaccactttaatcaggctgcccgggtcctttgccagtttttcaaaataagccggcgtttcctccatgctgacttccttgcttatgagcggggccacatggatcctgccctggttcacaagccccaccacggtcttgaactcttcataaccgtacaggaacgacccctggatggacagttcccttgtaacgatttcctgcatgttaacatccacaaatggtttgttgttgccgatccagatggcccttcccccaaaccgcaatgccgccatggcctgctgcaccgtgggagcggcccccaccgcctcgatggccacatccacgccctttcccccggtctctgcaagaatctgtgccttccagtcaccgctgcccggattgacggtcacatccgcccccatctccctggcaatcccaaggcggtaatcgcttaaatccgacaggatgatcttggcagcgcctttcattttcacacatgccagggccagcagcccgatggtacctgcgcccacgatgaggaccgtcctgcccgttaaatccccggcgtgttccacgccccggtaagacactgccagcggttccatcagggtgccgattgaatagggtatctggtccgctacccggaaacagcactttgcaggaacacagatatactctgcaaacgccccgtccacatccagaaccccaaatgcccgcttattcaggcagaggtggacatcgcccttcctgcacatttcacagtggccgcagaaatccacgggatagacggcaacccggtcccctttcttccactggtccactccctggcccagctccgccacctccccggcaaattcatggcccatcatcatgggcggaatccttctgcctgtgatgcccagataaccgtgtacatcacttccacagataccgcatgccctgaccctgagctttacctctcccggccccggacttacgtcacccacttcctttaaactaaggatattcggtccttcataaacaattcccttcattaccctgtccttcccttcccgacaggcatgaagcctgtcttaaaattcctgtcatatatccccgtcatccggcggtgtcccttacttcttctgaagaaagcattggagattcaccttgcgtatcgtttccaccggcaccttcggctccctgtcataggtcagaagcccatttatctcctgctccacatcacacagctgggtatacacaaagccctgtaccagaggtgatgcggccagggcggcaatcaatccctcatattccttcaggaattcctccccgctttcagccacagcatacccccagccctcatcctgattaagcctgtaggccacgcctccgaattccgacacaatgaccggctggccttcatacccatatccatgggcaaacagggtcctgttcgcgggcatggaggaaagcaggcattccaggttcccgtaccgttcctttaataccgccgggtcacaggtataatcatggatggtgagcaaatccgactttgtgtggttccatccatcattggaaatgaccatcctggtggaatccatggatctggtcagatagtacatgcatgcgctgtgggcctgttcctcctcacggtacatgatgttgtccacgccccaggactcattgagcgggacccatgcaacgatgcacggatggttataatcccgcttcacgatctccatccattcgggaatcatctgttttatatattccctggaatagagataggcattggcgcactcctcccataccagaaatcccagtttgtcggcccagtacaggaaccgctcctcctccaccttctgatgcttcctcaccccgttgaatcccatttccttgcaaagggtgatatcccttatcagggcctcatcgccgggcgccgtcatcagggaaccgcgccagtatccctggtccagcagcattttctgatagtaaggacggttgttcaggagaaatgtcccattctccacgctgaccttgcgcatggcaaaataggaatccgcctcatccactgccgtcccctggctttccagcttataatggacatcgaacaggaccggatgttccggcgtccactcataggatttgtgttcccattccaggttcaggttctggtccagcttccactcccggaccgccttcccattgaggacggtgacggtatcgcagaccatcctggttccctggtatgtaatctccacctgcagcctggcctctgttttttggtccagaaggatttccatgccaatcatcttccggtccacatccggcgtcatccacacctgccggatgaactggcttcccaccggttcaagccacacggtctgccagatcccggttgtgcgggtatagaaaatggatgcggactcctgtttccagtactgtttgcctctgggctgttccaggttccttgaatcgtccccggcccggaccaccaggacattctccccatccctgaggaaatccgtgatttcaaaggagaaggacgaatgtccgcccacgtgggcgccggcccattccccattgacccagacttcggtcctgtaatcgcaggccccgaaatgaagtatgtagcgcttccccggttccaatgcccgtccgtcaatgctgcggcggtaccagaccacatcgtggaatcccgtgtcatggatcccggacatttctgtctggtacgcgaacgggactgtaatctgtctggaaaaggggtgggacagataccatttttccctcttccccgcatccttgtcatcaaaaccaaactcccatttcccgttcaggttcatccagtcctgccgcctgaactggggcctgggatattcattcttaggtatatccggctgatctgtatgtgctcccatatcggtcatcctttcgtacggaaacggaacatgtgccaggaagacctgggtatcaccacttccagccgtccctgcgccaggatgtccgtaggtttaggggacggcgccacccggtccggttccagggccgaattggcttcctcatatccgtaaccttcaagggccgtatggcagatacaggactccgcctttacgcttcttaaatcacaggaaagggcgatatcctcctccatgctgcggttgagcacgaacatggttaccgtgctttccccttcatccgccacagccaccgcgtctaatacagtcacatccgtgtactgcctgcagtcgtatctggggcagtccatgttcacctttaacgcggttccacggccataaaggctggtgtaatagaatggataataaatggtctgcttccacgccttcccccctgtctcagtcatgatcggcgcaatcacattgaccagctgggccagacaggccatcttcacacggtcggaattctttaggagggaaatcagcagccctcccaccaccagggcgtcctcaaagttatagatatcctccagtctgggcggcgcctgtatccagtgttcaatcttcttgtcgctttccttggtgtggtaccatacattccactcatcaaaggaaaggttgatggttttccttgaacgcttctttgccttcacgtaatcacagatagccgtgacggaccgtatgaaatcatccatcaggacgcctcctgacaggtaggactgtgtatcgccgtcataattaccccagtaattatgcagggataggtaatccacttcatcgtagcactctgtcagcaccgttgcctcccagtccgcaaaggtgggcatcaccatcttggagctgccgcaggccaccagttcaatggaggggtccacccatttcatcatcttggccgtctcattggccagccgcccgtactcatatgccgtcttgtgtcccatctgccacgggccgtccatctcattgcccaggcaccaggtcttcacgttatagggttcttctttcccatgggaccttcgaaggtcactccagtaactgcctttcccatggttgcagtactccaccaggttcctggccgcgtccgctccccgggttcccaggttcactgccagcatcagttctgaatccactttcttaagccagccgtcaaattcctgaagccccacttcattggtctccgtggtaaaccaggccaggtccagccgggccgggcgctgttccttaggacccacgctgtcctcccagttaaagccggatacaaagttgccccccggataccgtatgacagggacatgcagttccttcaccagctggatcacatccctgcggaacccatcttcgtccgctaggggatggcctggctcatatatcccgttgtacacagccctccccagatgttcgatgaaggaaccgtagatgcggtcatcaatggttgaaatgatattcagacggtctaccgtcatatctgcctttttcaaactgttatctccttcctgcggcgtgccggaacaaccgccccgcccggtcacgccttataactataaccctaaaccatgattatcccttaataccggtcatggcaatgccctggatgatctgtttctggaatatgaggaatacgatgatggccggtacggaggcaatcacgctggccgtcatgggcagtgtgaattccgaaaggttcgccccctggaactgggggattcccacaggcagggtcatcattttctccgatgtgatggataaaaagggccagaggaaattgttccaggaattggtaaatgtgaatattcctacggccgccatggatgatttggataccggaatgcagatattccaccaccgctcaaaggcattggccccgtccagcactgctgcctctatcagctcatcgggaatgccgtcataacaccgtttcatgatcagcacgccgatgggggccgccaggctggggcacatcaggcccacatatgtattgagaagcttaagttccgccatctcctggtacagcggtatgatgatggattcaatgggcaccatcattccggccgtgataaggaggaaaatggcggttcgccctttaaacttcaattttgaaatggcgtaggccgccagggaagtcagcatcagggtgcctatggtaaccgcaatggcaacggaggcactgttaaaaatccatttgatgatcggcgcctttttggcaaccactgtgtaattatccagggagaacacaccggtcaataccttggacaggatgctgacaggggtcccatagggtttcagcgatgaaaccagcatccagattaccgggaaaatccaaaacaatgccgcaatatagacgataatatataaagcagcccttcccacggtcatttttttctttgtcttcatgggtttcctccttctcaatcttttttcctgcccaggactttgttctgcagcatggtgatgatgaacaccatcacaaaaaacgcaacggacatggctgccgcccgtcccatcctccggtttgtaaagcctgtctcatagatatagtgcacaatggtccttgtatgggtaccgggaccgcctcccgccatcaggtaggtctgcccgaacagtttaaaggaggcaatggtctggagcatgattaccaggaccgtggtgtcctttaacatgggaaccgtgaccgaaaacagcatctgccgtgaattggccccgtcaatcctggctgcctcgtagatgtcttccggtatatcctgaagccctgccaggaaaaggatcatgttaaatccaacggtccaccacacagtggtaatcaggatagccagccataccagccatttcgtattgagccagtacatttccccaatgcccagtacattggtaagctgtgtcacaaggccggtgtaaggctggaaaataaaaatccaaaggccggtcaccacggacatggacagcacatagggagagaaaaagcaggtcctgatgaatatggtgccctttaacctggagttgatgaacattgcaaagataaaacctaccaggacaatcgtaggcgtggagattaccacaaaaaacaaggtgttgaacatggcctgccagaaccctttgtcctgaaacatcgcagcgtaattctggatgccgataaaaaatgtcctgccgcccagcgtcgcatcaaaaaggctgagtttcatgcccttaaggatgggatacaggagaaagcacaggaaaaagagcaggaacgggatgataaagcaccacgccgttatgttctccctcaccgcattcttccgtttgattgattgatatgacttatccatggaatgcctccgatttcattgctgttaagttccctcgccgcctgttttttaaaactgccgcagtattacctgcagcagcctcaaaaaatatattttcctaacccggtatttccgtatccccgccgtcctatctgttataggaatccaggatttcctggaactgttcctgcatatggtccatggtagcctgcacgtcctgctcccctgcaatcatggcagccagttccctgtaggtcatctccgtaagtccggccacgccgcatacctgaggatagaattttgcatagttagcggaatccgcatagttttccctgtagggaagggccttgaattcctcggattccatgaccgaggtcctgctgggaatatggccggacttggcccatttgcctgtgttatccgtaatccatttcatgaattccatggcagatgtcttttccgcgtccgtaaggttggcattcttaggcatcaccagggtatgggaatccgcataaacggatttggtggtacctaactgcgggaatgacatggacacgaagttcagaccattggttccctcaaaggtggggattgcccagtcaccgttgatggtggccaccgcaacgttgccggtaaacaattccgcgccgttcttctggttcttgggccatatctcactgtccaccatacgcatcatgatttccagcgccttcctgttggcatcgctgtccagggtggccgtcttgccgtcggcatcgcacacatcgccgccgaactgggtcagcagggtgtaccacacatacatgggaagcccgttcatggaggttcctgacagaggcatcttgccgctgtccgccttaaccttttcaaaatattcaaagaacgcctcttccccatccggcacaaccactgtcccgtcatcttccaaaaggcccatcttctcaaattcatccgtgttaaaatgcatcagcagcagatgggtatccatgggcatgcagtagtgggtgccatccacctgggacgcttcctgaagccgtttcgtaaacccggtccagtccacggaagcatctgcggccaggctgtccaagggttccagcagttcatcggtcacatattccttaatcctggtaatatggttgaccgcaaccgtgggagcggaatcagaagtcatggctgccagcagcttggtatagtattcctctgatttgatgatcatgaattccacttccgtggtggggctttgggcattgaactcatccacaagggccgtcatgatatcgccgtccccgcctgagaacggggcccagtaggtaatctttgtcttttccccggacggggccgcggtatccgcgccctctgccgccttgactgtgttttccgtgcccccggacgtcccgccgcctgcggctgctccctgtcctcctccgcacgctgccagtgacgccatcatggtccctgtcaataccaaagctgtcattttctttacaaggtttcttttcttcacgtctgttcctccttttttctctgggccgtagccgggacgggtccggtcacccattcacgccccgtgggattttcccaataaaaagacctgccataagacaggtcctttccattcccaggatacatgttcctaacaacaagagccatctcatttgatgagataagcatatcatgtaatccatacaccgtaaatttgactgttttaataaaagtgtcaattcttaaactgatttttcccattcgtccggatatattcccccgggctgacccccgtatatttcttaaatactttcgtgaaatatttcacatccggaaagccgctggcctcggccacctcataaatcttgagctttccctcactgagcaggcgtttggccacgtcaatgcgtatctgggcccggtaggtggtatacttaatccccagttccttcatgaacagggtgctcaggtattccggcgtcacattcatgcgctgcgccatctcatctaagggcaggtcgcttttgtactccctgtccatgattttaagcacctggttgatgattgggtggttgccggacctgagattcctggtatactgttcatactgcatcagcacgttcaggataagctggggataatgctccagaaacaggctgtccctcacccactccaggatattcaggttgctgatattctcatacagcccgtagctggccctccgtatggcgtacaggacagcggccgtcaggcagataagggcttcccggatatccgtgtaggagtaaaccttctgcttgagatacaggaggaattcatccagatacccttccaccggcaatatatccccctcattgatgcaggtgatgatcttcctctcaagttccgatggatagctgaatttctgtgtctcaatccggcttatcacctcctccgtaaggaccaccggttcccccacggaaaggttccagttggtcatatcaaggagccgttccctctttgcctttatctcatccgtccccttaaggcaggtccctgcaaaaaccagataagggttaacctgctccctgcaccgccttacagccgggttcagcctttcgttgattccctcctcgtacccacgcagcaggatataattttccttgtggcgcgcttcccggcacacgcaggcttcaattcccggcaccgcctgtaccagctccgccacgatccgctcccagtcggcctgtaccacccggttctcaccccgtatgaggagaaggaagtccatctccctggacgtgaaccgtttcttccactcatcctcgaatttggacccggagaatccctgcatgaacagcgcccgctccaggatctgttccgtgtccatggatgaggtcctgatattctgggcctcctcctcaatggctgtcctgaccttgcgcagggattcctccaggatttcctttgtgatcggcttcagcagataatccatgctgcccaggctgatggcctctttggcgtactggaattccgcgtagccgctgaggatgatatagcggcagcccagcttttcctcattcagcgccttaatcatttccagcccggtcatgccgttcatccggatatccgtaatgatgatgtccgggtgcagttccattgccatacggattccctcttccccgcttctggcctggccggtcatctcgtactcccctcccagctcggcaatcaggtttgataatccttttaatgtcttccattcatcttccactatcagtattttcacgaatctcctcctggcctggcctcatgcactgcctgggtatcacggtttcaatggtggttcctttcccctcaccgctctccacatggatggagtaggcggtcccataatacaaatccagccttgccagcacgttcagaacgccgatggaattacccggattcatcctgcggacaaaaacagcgtcaatctgttctttggacatgcccagtccgttgtcgctgatgatgaaggccaggcgctcctcatcctgttcccgtatctggaccttaagcagtcctccgtgctccacatccgccatcccgtgaaggatggcattctcaatgaagggctggaatatcatcttgtggatcttgcaggtcttcaccgactcctggcactctatgacgtactcaaagctgtccatgaaacgtaccttctgaaggtataaataccgctccaggtaggatagttcctctgaaatcatgacaatctggttgctctgctggatctggtaacggagtatctgggcaaatttactcagcatgctgctgatttccttctggtcattctcaatggccagccagttgatggaatccagggtattgtagatgaaatgcgggttgatctgggcttccagcgccctgatttccgcctccttttcccttactcccgactccttcaccatctgcatctgttcattgaccgtgttcatcatgatgttgaaatgggtggcaatctggctgatttcatttttctcatcccggtggattcccacctttgcgttcagcttgccgccctggaccttgttcatcgtattgacgatatccgtgatatatttggacattttcttagacacgtacagtacggccgccagcacggccagggccagcaggaaagaaacggccagcacggtcttctggatttcatacagcctgtgatagacataattctcatccagcacgctgtacatcctccatccggtggacgggacctcctccataagcaccatatgggggctgtccggatccttcctgtccgcctcctcaaagtatccgtccaccagattgcctatgacgtccttatcatagtgggaaatgatcctgccgtccgcatccgtgatcagcaggtaattgatgtccctgtccccgcttacctgtccgttggcgcatatctcgcttaacacgctttcctcaatgctgactatccccgtccctacctggcggttagtgtagtaatccatgatctgcttgccgtaggaatacacatagtattcccgggtccccttccggtccaggtactgggtggacatccatttccccttaagccccccgttgtcctcaaaaatcccctggctgaaatactgctggtgcaggccggatatcttgggattgagcagttccacctcctggcggtcatagccgtagctgatgtccgaaatggtgcggatggacatgctgcgcacctccgaacggtaggtcaggaactccttcatggttttatccagttcagacttgattttccactcattctcctcattcatgctgttaagcgcattgaccgccattatgaaatccgtgtcccggaacaattcgtctatggccttcttatagccctttaaggaggtatccaggttcagggtggtctggcgcagggaattctggtaggattcctcaatcttctccttcatgaacctgcgcatataggaactgctgagtccctgtacgatgaccagctggaacaggaatacccccatgaagaccatggtaagctgcctggcgaatgtctgccgtttccagatatgtaatatccccttcatgccctattccccgttaccactcagccacggagccatccgcatgcctccagaccgggttcttccagttatggggcgtccggttctcctcaaggaccagctccttattgaccgcaacgccaagtcccggccttgtgggaagcttgacaaaaccgtccacaaaccggaaatcctccgggttatccacataatccagcacgctcctgcccacattatagtggattcccatgctctgttcctggatgaccgcgttgtagcaggtggcatccacctgcaggcaggagctgagggcgatgggccccaatggacagtggggggccagggccacatcataggcttcggccatggatgcaatcttctttacctccgtgatgcctcctgcatgggacaggtcaggctggatgatatccacgcctcccatcttaaacaggcgcttgaagtcccatctggaatacagcctctccccggtggcaatggggatctggcaggcagccgcaatctcccggaagctttccatgttctcgcagagcaccggctcctcgatgaacatggggtcgtaaacctccagcttcttagccaggattttagccatgggcttgtgcacacggccatggaaatcaacggcaatgccgaaatccttcccgcagcttgcgcggattgcatccacccgttcaagcaccgcgtcaatcttatcatagctgtcaatgaactgcagttcctccgtggcattcatcttcactgccgtgaatcctgcctccatcttctccctggccgccgcccccacgtccgagggccggtcgccgccaatccaggaatatacgcgcatcttattcctgcagctcccacccatcagctgatggacaggcgcattaaagtatttccccttgatatcccacaaagcctggtcgatgccggagatagcgctcatcagcacgcctcctccccggtaaaagccggcccggtacaggacggtccagatatcctcaatattggcaggatccgccccgatcagataatcctccatctcatgtacgcaggccagaaccgtgcctgcatgcccctctaacacagcctccccccagccgcttaacccttcgtccgtgatgatttccacaaatccccagcgcggacggacaaaatacgtgttgacttccttgattttcatataagccatctcctttcccaacaggttcatcccatctgtaccatctgtaaatgacactatccacataacatgtggcatcatacaaaatatcacacaaaaatccccatgtcaatttttatctaaatcccgccatccaggggggctgtaatcatcagattgcacaatcattattagaaggattgaaccaataaaacaaaacgccggcctgcatcctttcctcaaggccatgcagaccggcgccgattttcctttccctctatccttactgcccctgctcccccataatcctcagcaggacccccacgatatccggatcataccaggaagcgttctcctcaaacacacctccatcctcccctgaagcaaaatatgcgtcagccgccgcgatgatacgggagagcaggggaatatccctgccagccaggcctaccggccatccgctgccgtcccaatgctccgtatagtggagcaggcaggccgctatattcctgtattcctccagggaagacaggagacggtaagcatgttccgtatgtccccggtccatcccgtccttatccgggccgcccggccggaacaggctgcacatgccaatcctgcgaagctggtaaccctgttttaacaaagcagcagagtccgggcacagggcttctgccagtttcccaagaacctcctcttccggcctcgacaggcgggtaatcaggccctccccctgtgcggcccggataatattgtccaccgtgtcccgcttcatctgtacgctctccgtcagcttctcctcatacatcatacggtccgccttatgcaggatatcctccatggattccgttccctccgccttcacggcatagcccagggaagccgaaacctctgccccgcatatattctccttgggaaaccccagacgtatgcggcttatgattttccgggcatcctcagccgtggtgcggggcatgaggatggcaaattcatccccgccaatccgcgccaggatatcgtcctccctgcagccgcgttccaggcaccgggccaccctgcatatcagccggtcccccacatcatggccaaacacgtcattgaccagcttcagaccgttcacatcacagcataccgcgcacagcggataattgcgcggggtatcaaggcgcttcagttcttcggcaaaataacgcctgttatacatctctgtcatggaatcgtggaaactcaggtattcggcggccttctgcatctcctcccgtttgcccatattcaggacaataacctcaatgctgtcagcaatcccgttaatctccgcattggtaaagcccagatcaggattatcctccgggcagccgtccgctaccttttcaatcctgtcccgcagcgccatgattggccttgcaaacctgtatatcagcacccggctcaatacaaatccaaggatgactgaaatgaacacgaccagacccactaacagtatcacgccatgcacaatcggaaggattacctcggaggcgtcaatggcggtggccacaaaaaagccagtgtccggtatccgttcaaagtacgccatggcgttgaccccgtccttttcatattcaccgtaattggtggtcccttccaccactgcttcccatacagacgtgtctatatagttcatcagcgtatcgtcgatatatctttcctccggatggatgattacatttccatccatatccatgatatagctgcgctgggacttatactggtatctggcgcttaactgcctggatatactgtcattggaacagtcaatgctcacaacgcccacggtttccccatcctgatccaccagcttcttacactggctgaacagccattcaccggtggccgcgtcactgtaagccagccttgcgaccccatccgtttccatagccgcgtcataccagggcctgtccatgggggaatagccggaaggcgtgtcataatcactgatgtacaggcttccgtcgtcatatcccgaatatatgtaggtaatattgctgttgtccgcctggattgcgccgtaaatgtccagaaccgcctggggattcccataccctccgtggataaccgtgtcatccctggacaggatacccaccacggctgcattttcatggaacatgctttccgtgtaggtgacaatctggctgttgcattccctcagggaattccttgcattgtccacattggctgtgtacaggatccgcaggaatacacaggcaaaaatcagcgatacaatggacagggaaataaaactgagcaggaatatttcctttttaatggtcaaaaaacgtttttttccgtcctttacccttccctcgtcccccatggaccttcctccttacacacatcgttttactagattatagcacatacatgacaaaacagttacaaaaaatgctgccgcaaaatgccatacagacatttcacggcagcatctgccattccatacaattcaatcaatagcccgctccctcacaagccaatcaataaatagcccgctccctcacaagcaccgtaggataccccaggttacggagggtccgctccatgcgcaccgcataatccatgttgaggaacgcgcccaccctgaccttataaaggccgtcatcatacaccacgaacgctggcagtcccttggcctggagttcatttaccagacggtccgcaggcatcctggtgcgaaacgcgcccacctggacctgataatattccggccgctgctcctcctgctggcgtatggtctccaggatgccgtccgcaattgcctgggcaatggcgtcaaaattctcatcaaagaatctgttgtcctccggattatcgataaatcccgcctccaccagcacggccggcatctgggtccgcctgagcacgatcaggcccggacgctcctggattcccaggtcgttaaagccggtctgcaccaggttgcgctggatattttccgccagcatggccgggacccctgcgttctcatatacaaggaccgttgccccgcttcccgtgccgggcacaggcattgcgttgcggtggatggacacaaaataatcagcgccggaacggttggcaatctgcgctttttcaaggggcgtgtcaaacacgtccgtggtccttgtataaaccacgtccaccccgttattctctaatatctgccctattgcaagagccagccgcagggcgtcgtctttttcccgccgcccgttaaacatggcgccgggttcttcaccgccgtggccggcatcgataatcactctcttaatgtctgccatatcagactctccttcacatatgactctacactataccatatgtgaaagtgagacaaatgttgacactaaatttcgtccacatccactcccctgggacccacatgggtggaaaatacaatctgtgtgctcgtcttaccgaacttctgaagctgtccgatgaacatatcaagctccatggtgctctggaacgccactttcatcagcatggaaaaatcccctgtaacgcagctgcactccaaaacattgggcacttccttcgcatacgcgtaaaatttgggcttgtcttccggcaccacgtccaggttgatgaaagccaggatgtggtaccccagcttcatggggtccaccatggcatggtagccggttatgattccttccttctccagccgctcaatcctggcggacacggccggcgaggaaaggaaggtgttctctgcaatggtcttaagggacatccttgcattggcctgcagaagcttaagtatcttgcggtcgatatcatccatactcttatgttcctcccttggcagcgttattgtctgagggcctttaacctctccactgcctttactgtattttcataagttccaaatgccgtaagacggaaatatccctcgccgctgggtccaaagccgctgccaggggttcccaccacattggcctgttccaggagataatcgaaaaattcccagctggtcatgccattttccgtcttaagccagatgtaaggggagttcacgcctccgtacacgctgtaccctgcctccttaagcccctcatggatggtccttgcattcctcatgtaataggcaacctgctccatgacctgccggttcccctcctctgaatacactgcctctcccgccctctgttcaatatagggcgctccgttgaacttggtcccatggcggcgggcccacagggaatgaagggacatgtccccgcacttcaggtccttcggcaccacggtaaagcccaggcggacgccggtaaaaccagccttttttgaaaatgaacggaactcaatggcgcaggtcctggccccttctatctcaaagatactgtgggggacgccgggttctgagatatacgcctcataggcggcatcataaaggatgacggcccctgcccggttggcataatccacccacaccttaagctgtgacctgtcaagggttgtccctgtggggttgttggggttgcacaggtaaatcaggtccggcgtctcctttggaagctccggggaaaacccattctcctccgtacagggcatgtatatgacatcactccacatcccggtgccttcatcatattcaccggtgcgcccggccatcacattggaatccacatacaccggatacaccgggtcgcacaccgcaatcctgctgtccccgctgaaaatctcctggatgttgccgcagtcgcttttggccccgtcagaaacaaatatctcatctgcctccaccggacagccccaggccctgtagtctttttccacaatggcctcccgaaggaaggggtaccccagatccggtgcatagccgtggaatgtctccgcgcgtcccatctcctctgccgccctgtggatggcctccaccaccgccggggcaatgggcagggtcacatcgccgattcccaggcggatgaccgccttgtcagggttggcctgctgatatgccgccacctttttcccaatggttgaaaagagataactgccaggcagtttcaaatagttctcattaatcttaaacatgtgtgttcctcctgtcctttccggaagatatcttgccccgcctccccggaaccagtgcccggtgctaaggcgtgtctcccataaacgtaaacgctcccaggaaacccgtccggctccgtacaggactgaaaggacagcaaataaccaccatcacagggcctgtacagagacaaacagcacatcttcgtgcccgtggtccctgagagtgtattgattacatatagtttaaagtgttaactgattaaagtcatcttgtcaatcataatatatttcctgcggtatgtcaatacttccgttaaatacttccaccgcagggcctgtcatgaaaagacggccagtggcgcggtccaggcgtatcataagctttccgccgcgcagggaaacctccgcctcatcatccacataccccatgaggatggatgccagcacgctggccgtggcgcctgtgccgcaggcccaggtttccccgctgccccgctcccagaccctcatgttgagatgcttccggtccaccacttctatgaactccgtgttcacccggtccggcgcaaaccgctcatggtattcaaaggcagggccggttttctccaaatccagcctgtcaatgccgtccatatagtacaccgcatggggattgcccacatcgatgcccacaaacctgtaatccttcccatccacctgtatgtcctcaggaaggtctgaagtcagggtcccctctcccatatccacggtgattgacacggccttcccgtccttcacctccagttcaagggtcttgatcccgcccagcgtctctacggtcatggtcctcctgtcagccggcaccaggccgtggtcgtaggcgtacttccccacacaccgcaccccgttgccgcacatggttccctgggaaccgtccgcattgtacatctccatcctgcagtccgccttcccggacgggcagataaggataaggccgtccgcccctatcccgaagtgacggtcgcttatgaaccgggctacctttcccggctcctttacctgttccttaaaacagtctacatacacataatcgttgccaatcccctgcatctttgtaaacttcattcccacacctcacacatgaattaaactgataaccatctgggctgtttccaccaggttggtgccgctgtccatactgcacttctggatgtacctgtgagcctctgattccgtcatattgttgcgctccatcaacagcgcctttgcctcgtcaatcagcctgcgttcctcgccgctccgctccctgggccggtttttcatcttccggcggaaacggacctgggcctgcaccatcatttccagggtgcttataaggtcatggaccttcaggggcatgggaaggcagattacattgcccggggcctggcctccccaacggctgggagaggagatgagcagcatgtcaaatgaagccggcagatactggcgcagctcatcgtacagcatatcctcaaaccggtagccgctcaccacgatgccgctgcccaccccttccgccgccgacagcgcctgtgaaccggatgtacagacagcgaccacctgatagccgttacgcaccagaatcccttttatattctttccatcctccggtttggagaacgctacgataatgttagtcacatgcctcacctccaagcaagcattgggaccggaacctcattgcagtaccggcgtcaatatttataaagatattcgcttacttcccagtcagtgacctgagccctgaaatcgcgccactccttttcctttgcttccagatacttggtatagatatggtcccccaggacatccttcatgaaccagtccccgtcaaacgcctcaatggcatcccccagcgtctccggtatgcgctccacattcctggacttcatctcctccggcgccatggtgaacatgttgccttccacgcactccggaagttccatctgcttctcaatcccgtccaggccagccctcaggcatgccgccagggccaggtatgggttcatggctgaatccgggcagcgcagttcaatcctggtgctttcccctctgggtgaagggatgcggataagggaactgcggttggaggtggacgaccaggcgatatagatgggcgcgtcgtacccaggtatcaggcgcttgtaggaattcacaagcgggttggtaaggatggtcataggcttcatatggtgcaggatgcccgccatgaaatagtaggccgtgcggctcagcttcagtgggtccgagtcgtctgcaaacaggttcttcccgttcccgtccgacagggacatattgatatgcatccccgaaccgttgatgccttccttcggctttggcatgaaggtggcatgaaggccatggcgcttggcaattgtcttggccgccatcttgaaggttatgatgttatccgccgccctcagggcatccgtgtactggaaatcaatctcatgctgggccggggcaatctcatggtggctggcctcaatctcaaatcccatctcttccaggttaagcacgatgtcccggcggacattctcagccaggtcaatgggggatacgtcaaaatacccggccgtctcatgggtattggtggtgggccttccctcctcgtccgtgtggaaaaggaagaactcgcactcaggtcccacattgaacacatatcccatgccggcggccttcttaaccgcccgcttcagcacattcctgggatcccccgtaaatgcggtcccgtccggattatacacatcgcagaccagccttgccaccttgccctgctggggcctccacgggaatatctcaaaggtatccaggtccgggtacaggtacatgtcggactcgtcaatccttacaaatccctcaatggcggagccgtcaaacatgcagcggttatccagcgccttcccaagctggctggaggtaatggccacattcttaagcataccaaaaatatccgtgaactgaaggcggatgaactccacatcctcttcctccaccatgcggataatgtcgtccttactgtatttgctcatctctattctccctctcttgcaaactgcaataccaaccatgtggatccgtgaaacaggaaaggcggggacgccctggagctctcccgcctcgctctacaaaaaatatagcaacagaatttttatttgtcaatgtgaattgacgatttcgtgttttttaccaatatcactttaaagcgcgaagttgttctgtgaaatgattacctaatttcatggtgcccacataccccacatccccggtcatgtgcacaacgccatcctcgtcaatctcaatctccaatgttccgccgggcatctggaccaccatcttggggtctgtcaatcccagacggtaagccgctgccgctgccgcgcagcatccgctgcccgaggccagggtatatcctgcgccccgctcgtaaacctcggtctggatatgggtcctgtcaagcaccttcatgatctgcgtattgattttctccgggaactgccttgcgccctctgaatatttcccaatcctgcacaccaggtccttagatatctcatccataaggatgacacagtggggattgcccacggacaggcaggtcacgggatatggaatccgtccgaataccattgtctcattgatgatttccctgcgcgggccttccaccggcacgtcgctgctccagaaggaggccctgcccatggacgccttcagccgtgtcccttcctcgttcaggtagtggattgccgcctcgcctccgctggaatagatggtaaaatcctttttctgcacatatcccgcgtccttcaggtatttggcaaatatcctgaccccattgccgcttttctccgcaatgcttccgtccggattccacaccaccatggaaatcctgtcctcactaatcacaggcccttccagcacgccgtccgccccaacgccgaaattccggttgcacatcagctgcacgttggacgggttcagtttcatttcatttttattagggtcataaaccagataatcgtttcccagtccatgatatttctccactataagcctcatatccatatcctccatattttccaggcattccactttacatcctgttttatattttatcaggcattttatcataaaaatatagatatgatgctattttatattgcaaataatgctgtcattcgtatatactgttcctgtaaggaggaataatccatgtatataagcgacggctcccctgccacccagaagcagggatatctggaaggcgacttccgtctgttccacattaaggataaactgcagcgcacctacgatttccactatcatgatttcctcaagatcctggtacatctggaaggaaatgtaacttatacaatcgaaggccgttcctattccctctgtcccggggacattgtgttggtggaccgcggacagatccaccgcccccaggtggattttacatccccctatgagcgcctggtcctgtacctgtccccggactttctggagcggtacggcgaaaatggttcttccctggacagctgtttttccaccgcggcctaccgccattccaatgtgctgcgcttaaaggaggatacccgccgtcccatgctgtccctccttcgcaggctggagcgggcccagaactggcaggaagaagaatttgcaggaccgctgtactgccgcctgctgtgcctcgaattcctggtggaacttggacgggcatccatggacgccaacgcccagtacatccccaccggcactttaaactaccatgtgtcaggacttatatcctatattaatgagcacctgtccggggacctgagtatccgtaccctttctgacagctgctgtctcagcccctaccacatgatgcgcatgttcaaggaggaaaccggttacaccatcggaaactatatcacagaaaagcggctgttacgggcccgcgacctgcttgcccagggaaaaagtgcgaccgaaagctgcttttcgtccgggttccagaactattccacctttctcagggcttataaacagcactataaagaactgcccaaacgttctgtccggttaaaaaacagtaaaaattaaagtatttctgattttttcttgaaattttcgtaatatctgatataatatactcattgttttcccattgaggacagttgtctttgccagatgaacacaccttgcgcaggggatttggaatcaatggatcattcatgaaatgaggaggattgtagtatgagaatcaggaaaatcatggccgtaaccatggccgcgtgtcttgttgcaggttcccttgcaggatgcggcaagaaagcagaagaaaaagtcatcaagatcggcgtgtttgaaccgaccacaggtgagaacggcggcggcggattccaggaagtactgggtatccgttatgcaaaagagatgcacccaaccgtaacaatcaatggcgaggaatacaaagtagagctggtggaggttgacaacaagtccgataagacagaggctgtcaacgcagcacagaagctggtaagcgagaaggtaagcgtggtccttggaagctacggctccggcgtatccattgcagccggacagatattcgcagacgccaagatccctgccatcggctgttcctgtaccaacccgcaggtaacggagggcaatgatttttacttccgtgtctgcttcatcgacccgttccagggcacggtaatggctaactacgcattccagaacggagcaaagagcgctgctgtgatcacccagctgggcgatgactactcctcaggccttggttccttctttaaggatgcattcgccaaattaggcggggaaatcgtaagcgaggagcagttccagaccaaccagactgatttcaaggcaatcctgaccaatatcaaggcagccaaccctgacatcatcttcgcgccatcctccatcaccactgcaccgcttatcatcaagcaggccagggagcttggcattacggcaaccatcgctgcaggcgatacatgggagaactccaccatcatcgagaacgcgggcaaggatgccgagggcgttgtgctttccaccttctttgacgaggctgaaccggccaatgacgaggcagccgccttcatcaagggcttcaaggaatatctggtaaagaacaaacaggaagacatcatcccggccgtatccgcactgggctatgattcctacctggcagccatcaaggccatcgagacagctaattccaccgacaccactgcaatccgcgatgcgctgaagggcgtccagattgacggcgtgaccggaagcattacctttaatgagacaggtgatgccaacaaggatatcgccttcatcaagaccatcaaggatggcaagttccagttccttacaactacaaccgtagagtaaggtcatctgacagttacatatgacacagaggccgcaggcggcagccattgccccgcggcctttctccggcttatggcggaggcgcaggataccatgtcctcatgccattccctgcaggatacaattattaagaaaacaggaggcagactcttatgagtttaacaacatttctacagcagtgcctgaccggtatctcccttggcggcgcctatgcgctgattgccatcggctatacactggtatacggcatcctccgtctgattaatttcgcccatggcgacatattcatgatggcaggttattttatgattttcgcaatggccagccttccctggttcatcgcaatcccggttaccctgattgtcaccgttgtccttggtgttaccattgaacgggtggcttaccgtcccctgcgttcttcccccaggatgtccgtcatgatttcagccattggcgtatcgtatctgctgcagaaccttgctacctatctgttcacggcccttccaaagggatatcctgagattcctttcttaaagaggatttaccagataggcggtctttccgcatccttcgtaaccttcctcacgccagtcctgaccctggtcctggtatatcttctgatactcctgatcaaccacaccaaaatcggcatggcaatgagggctgtttccaaggattacgaaaccgcgtccctgatgggcatcaaaatcaataagaccatctccttcacctttgcagtgggttccctgctggcaggaatcggttccatcctctatttcacggaccgtatgaccgtattcccgttctcaggcgcactgcccggcctcaaatgctttgttgccgctgtattcggcggtatcggaagcattcccggcgctgtcatcggtggtttcatccttggacttggggagacagccctggttgccatgggacagtccaccttcagtgacgcatttacatttatcctgttgattgttatgcttctcatccgcccgaccggcctgtttggtgagaagacaaccgataaagtgtgaggtggcggacatgaagaatatgacaaagaacaaaaacaaggtttataccatcattgccctggccgtgctcattggaatcctggcattcctgcagtctgacacggcagaatacagttatcagatatccatcctggagcggagcgccatctatgcggtggtggctgtttccatgaacctgctcaccggctttaccgggctgttctcccttgggcaggcaggcttcatggcaatcggggcctatgtcgtggccatattcaccatccctgtaggctcccgtgccagcgtatactatgtgagcgggatctcacccgtgattgccaatgtagcgcttcccatccccgtggccctgctccttggcgggcttgccgccgctgtcctggccgcccttatcggcatcccggtgctgcgccttaagagcgattacctggccatcgcaacccttggcttttcagaaatcatccgcgccttcatcgcagcgcccatgtttgacactgtcaccaacggttcctacggtctgaaaagcatccccggcttccccaatatctttgctgtattcggtctggcagccctctgcatcgcgctcatggtactgttaatcaactcctcctacggccgtgtctttaaggccatccgcgaggatgagattgcagcccagtccatgggacttaacctgttccgctacaaggagctttcctttgtcatctcctctttcttcaccggggttgggggcgggatgctggccatgttcatgcgctccatcgattccaagaccttccaggtggcgcttacctacgaccttcttctgattgtggtcctgggcggtatcggaagcgtcacgggaagcgtcctgggcgcgttcctggtaacctcgggacgtgaactgctgcggttctttgatgacccgttaaccattgcaggggtgcatatcccgctgttccgttccggtttccgcatggtcatcttctccatccttttgatggtagtggtgctgttctaccgccgcgggatcatgggcaacaacgagttttcctgggacggactgtcccggctcatacgcggcatacccgacaggctgaagaaaggccgcggtaagaaagccgcctccaaaaaaggaggtgccaagtaatggataacatgaaaaacgtacttcacatggacaacgtaaccatgcagttcggcggcgtggtagctgtcaacggattatccttagatgtaaatgaacgcgaaatcgtggccctcatcggacccaacggcgccggcaagaccactgccttcaactgtgtgacaggcatctaccagcccacctacggctctgtttcctttaacggggaaatgatcctggccgacacgcctcagggcaagatgcgccgtctctacgccggggacgtggcgccaaaggagcttacgcccgtgcgcaagacgccggatgaagtgacaaagcttgggattgccaggacattccagaacatccgtctcttcggcaacctgaccgtatttgacaatgtactgattgcaaagcacatgcgcgccaaacagaacgtattctccgccactctgcgtttaaaccatgcagaggaaaagcggatgcgggatgaatccatggagcttcttaaaatgcagggcctggcacaccttaaggatgagattgcctcctccctgccctacggcctgcagcgccgtctggagattgcacgcgcgctggccaccaaccccagcctgctccttcttgacgagcctgccgcgggtatgaatccccaggagacacaggacctgaccgatttcatcaggcagatccgggatgactaccatctgaccatattcatgattgagcaccatatggacctggtcatgcagatatccgaccgcatctatgtactggatttcggcaagctcatagcccatggcacgccggatgaggtacagaacaatccaaaagtaattgaagcatatctgggggtgagtgacgatgttaacgattaaagatctgagggtaaactatggggggattgaagccgtaaaaggcatcagcttcgaggtcccggaaaaatccattgtcaccctgattggcgccaacggcgcgggaaaaagcaccaccctgcgttccatcacaggactggtcaaggcctccggcggttccatccagtttgacggcgcggagcttctgggcatggacacgccggatatcgtggcaaagggcattaccctggtaccggaaggccgccgggtattccccgacatgacggtaatagagaacatcaagattggggcctacttaagaagcgattccctggaggacaatatcaactgggtctacgacctgtttccccgtctaaaggaaagaagctggcagctggccggcaccctttccggcggcgagcagcagatgctggccgttgcaagggccctcatgagccgtcccaagctgatgatgatggatgagccgtccctcggtctggctcccctgattgttaaggacatattcagcatcatcaaggagataaacaagcagggcgtgaccatcctcttaatcgagcagaacgccaacatggccctgaggattgccgaccaggggtatgtactggaaacaggacgcattgccctgaccggcaccggcagggagctgctggcagacgagtcggtaaaggcggcatatctgggaaagaaaaagaattaaacaccgcttcagattgcaagggaaacctgggctgtataaaagcagacgataaaacacaagggaggaggatggcctggattggacaatgggaaccaatccagaccatcccctcccttgtccttgtgtgtggacatcctgatttacaatcatccatatacatttatatccctgcccgcttatgtccttatacacccatggatatcccctataccgcacccctgtctaaatccgtcccaagcatcataggtttcctgtcagaaagacaggattaaaccagccaaatcacacctgcggggaggtaaaaggtatggatataaatatcttcaatgaaaagtttaatataacggtttccagggatatgacctatacaccggattccgttgacaataagccatatgacatggaaatccgggcaatatcaaccatccatgacggaggacattattcctgtcattccatcgcggtcgaagatttttcagatggcgggactgtaacaatcatcctggtaggggactactgttccaatgtgggaaaggattccgttatcttacggaacgatacgcttatcatactgctggatgccgtcatcgtggtattatcactaaagagtgccatggaccctggaagtcatgatatccaccggataaaaaacaatttcgggacctactattccatctatcctgttggaaacaactatatcatctacggggaattagaagtaaagatgctggacaaagcattccgtgaagtctggacctattcaaccacggacatcctgatcaacccggattaccaccttaacatagatgataagcagatttcctttacggactgggatggaaaccaccacctgttggatatggacggacatcttctctgttataaaaaacgggagctgaacgtgattgaaatcaatgtaacccccataaacacccccaaagaactacaggcaatcatcaaaagcaggctaaacatgccggacttttacggaatgaactgggacgcctactgggatggcataaccggactcatccccatgccggacaggatcatcctgcgcggttgggatatttacaaagaaaaacagcccggggatgcagccgcattcgaaaaaatcatggcaagatatacccgtctatatgggcattgccaatgcatctatacataaaacagaagcaggtatggcatcggctgccagccgtacaccatacctgcatccacttccatcatccagccatcacagctgtgtgaatccataagcattcaccagtgcatccagcttacgcttctccctgcacaaaggacagtccctataatcataatatgcgtaatccggcacatccttcttaccaaaaatagaagtaatccgatacccattcacctcatccacagcgctgaatatggcagtaacccctctcaggatgccgccataatactgaatggcctcaatccccttattaagggccagtcccgtggtaacagacgccgtcatgataaggacgttcttatccctgatcataggaaggttattctccttaaaaatcatctggctgttgctattatactccggggtcactatgtacatggtcttatgtgcattcatggaaaggacgcccgcgctggtcagctcatccgccagaaacgccccaatgacctgggttccctccaggcacacgatcgtatccaccaccgtatcatagaggaacatccccaccaggctctttgcaatctcccttgcctcactaagcctggtcttcagggtggtcatatcaagataataattgatatgggcatgattggttgcaaaatgaccgggtgtaatcttcagcggcgcattacatcccgctgtctgaatctttgtatacttaacatccataaaaacgcccccttctgcatcgggcatgtttgaagtcaagccttcaagcacactcctttttccaacatcagtatctatctattattatactaaaaaaaccattcccgcacaagagtcgtataatttatcatcccaaaatccatttgacagttttcaaccacaccaaagaacatttatcaaaaatccttctccctccagccaacaaaacccccaccgcgaatcccccatcctttccttcatggccggagtacacagtccgggaagccgggcggggcttgtcctgtgcggggcgggagggttccttagggcgtgtttgaaaattgctttccgtcagctgtgcgtcccactttgtgggagatttagtcccgatgagggaggcgtagcgggctacgttgaccgaattgggactaaatataccgcgaagtggggcgtgtagatggcgggaatgaatttgcaaacacgccccagggcagctgtggattggacgcatagtggaggaggcagcagcttcttaggacctggcagatgaaaagacgggggtggattcctgcatcaaagcaggaatccaaggtgctctgaacgtagaaagtccatcaggatttctacgtgaatagcaccggtcccccgtcttttcatctgtcaggttcttagaagctgctgcctccgcaactccgcgtccgattcacagccgccctaaggaacccgcccaaacccgcgcaggacaagccccgcccggcttcgcggacgtacctcccacaaccactcaattctccttactataactaacccccagtttcgccggcacattaaaactcttccttgaaaccgtcagcacaatcgtcaatatataaggcagtgcaatgaacagctcattggggaagtatccgcctccgcccatggactgcatatagatagccacggcctccgccagtccgaacaccaccgtgccgatcacagccccctttggattccagttcccaaggaaacagatggcaaatgcaatccatccgcgccctccgatcatgttggtggtgaacatccccagatacccaaccgagtaaaacgagcctgccacgccgcccataacgcctgccagcagcacggtgaggaaacgcaccgtattcacattgataccagccacgtccactgcctccgggttctcccccgtggagcggatggtcagcccgatggatgtcttaaacagtacaaaataagacaccggaataatcaggtacacaatataggtcagtatattctgctggaacagcaccggcccaagcaccggaatcctgctgagcaccggaatggcaatctcaggcaggggactgattttcaggggcgtggtggggacaccgaagaacaccctctgaaggtacgtgcagataccggctgccagcacgttgatggcggttcccgtaaccacctggtgctgcttcagatagatacacaccaccccataaacagcggccgcggccacacctgccaggatggcgcacaggatgccgataaaggcattgcccgtaatataggttcccacgaatccgccccaggcgcccatgaggaaaatgccctcaatggcagttaccatcatgccggaacgctccgcaaccacctctgcgatggagccgaaaagcagaggcgtactcatcatcaacgcacgtttcaataaacttacaaccatagccttacgctcctttctgcagtttcagtttttctctccggttctccagataatgccggaagaaataggagacaatgacaaacagcatgacgaacccctgcatcagatccacgatgctggacggtacgtttacccccggcatacggcccatcaggttgcccatgacaccaagggcgccgaagaggatggatgcaaaaatgataccgattggattggcattggccagtatggcgatgcccaggcctgcggaaccaaccccgctgttaaaatcctggatcagcatgtgctgcacgccgtttacctctgtgaatccagccattccggccagggcgccgctgatgaagaaagcggtcacaaatacctttttagagttgatgccggacatcctggccgcggaatcattgcttccaaccgcgcggatgcggtatccaagaggcgtcttgtacagaaggatccagatgccgattgccaccagcacagccagcacaaaccccgcatggagcctggttccctttacaatggtcggcagccacgccgcccttgtgatggcgtctgtctggggatactcccccttggactcctttaggaaggtgcgcagcagatagttcatcacattcagcgcaacataggttgacatcatgcttacaaggaattcatttgccttgtaatgggctttcaggaacccgattaaagcaccaatcaggccgcctgccactgccgtcgcaagacagacaaccaccagaagcaccggcgccggcaccttgccgtccagtttaagggacagcgcaatggcagccacggcgcccatatagaactggccctgtgcgccgatattgaacaggttggccttaaaggtaaatgcaaatgccagcgcagtgaatataaggggcgttgcctttaagaaaacctcccccgtggtatatttatccgtcagcatggtggtgacggagtatgtaaatacctccaccggattgatatgcagcataagaagcatcagaccggaaagcagcaggccggcaagtatggcaaccgcgttggtcacaatcatatcacgtattttcccattcatgcattgtcccctcctcttctttgtagcctgccatgagaagcccgatccgctccgttgtcagttcatcatggcggtagattcccataaacgcgcccttatatataaccgcaatccggtcgcacagttcaaaaatctcagacagttccgtggataccagaagaatgcccttgcccttcctgcgctcttccagtatgctggtgtgtatattgttgatggcccccaggtccaggccgcgggtgggctggtccatgatcagcatttccccggcattgcccacttcccttgccaggatcaccttctgctggttgcctcctgaaagcccgcgtatctgggcatccggccccggggccttgatttcaaaatcctcgatggctttccgggtatagtcatacagctttttccggttgaggaagccgtgtctggtccatgtccggtcaaagcttgtcttgagcatcatattctcagccagggtcatttccccaaccatggcgtccctgtaccggtccacaggcacatagccgattccaagaccgatccgttccctgaccgaggtgcccgtgatatcctttcctttaaggaatacgcttccttccgtaacgggaagggcgccgcagatgacctcgcacagttcctcctgcccattaccgctgaccccggccacgccgaagatttccccctccatgatctggaaggaaaggttatccagcaccggcatggcgcccttctgcttcacggtcacgtttttaagctccaggcatacattttttctgatgccatcctcttcctcttcccgctttgcaaccaccatctccttgcccatcataagccttgccagttccacctcattggtttccttggccgtcaggttccctgttagccttccattcctcatgacaataatccggtccgccacttccatgacttccttcatcttgtgggttatgaaaatcacggaattaccctttgccgtgtattcctttacaaactgcatcagggtttccgattcctggggcgtgaggacagccgtaggctcatccatgataagaaggctggtcttcagataaagggcctttaatatctccaccttctgctgtacgccgaccgccaggtccgcaatctttgcatccacagggatatcaaagccatactgccctgccagctcctccacttctttcctgcatcggtcgtaatcaatgacgccgtgtacattgcccagtatgatgttttccgtcaccgtatgtgcatttaccagggaaaaatgctgctggatcatggaaatgcccagggccatggcgtcctttggggagcctatcttctgttcctttccatccatgaatatctgcccttcatccgctttataaaggccgtacaggatcttcatgaccgtgctcttccccgccccgttttcccctaacagggccagaacctcccccctttgtatggagaaggaaatgtctttgttggccactaccctggcgaaatattttgatacattcctcaactcaaaaaacggtgtatccacaagcgtcatcctcctttaatccattggtgcgcggcccgcggcagctgccgcaccgctataaaaccgcaccgctgtaaaaccgcgctggtataaaacattgctgatataaaaccacacccaaaaggctgctgcatccaaaaccattcctgcagcagccctttcatatctaccatattatttttcaaacattgcctgcagatctactttcccatccttgaaatccttcagtccctggtcaaccgcagccttcacctcatcggtgatgttgtccgtgtatacaggtacgaagatatcctcattgatgccggcctcatggaccatgttgcctgaaagctttccttccatgtactgcccgattgcccatacatagaagttcttgaaatcaaagtttacggaagccaccaccgtgtttgggtcaatggtggtctggtcgctggaaaagccgatgaacttggctccctttgccttggctgcctcaatacatcccagtcccacttcgttggcatatacaaacagtgtatccgcgccgttgtcaatcatctgctcagccatctgtttgcccagggccacatcatcccatgtattggcataagcccttgttgcctttgcgccggagatgcctctctcctctgcgattttaaccgcgtttttctcatatacatccatcagatgctccatcggctcattggggaagccgccgatggttgcgaagtttccgttctctgtcacgtatcctgcgataatggatgccacatagctggcttcatattccttcgggaaaataggggccacattgtcgccgtcacacttggaaccattcacggcgcagaaggtggtgtccggatagttgggggccacggctgcaactgcctcgtcaaactgggaaccggccgccatgatcaggtcatatccccgctccgcatattcccggaatgtggattcatagtcagaggcctgaacattctcaacgtattccatcttggtgcccagtgtctcattacatgcaaccaggcccgcatagttggttgcgttccagctctggtcattgattggtcccggaaggatcagtacaatcttataatccgccgcgcttttgccgtctgctgcgggcgcagctgcctcagccaccttggtatcagcttccttgccatcccccgcaggcgccgccgcctcagtggctgcctttgtctcagctggtttgccggaactgcagccgcccagtgccgccgtacttatcaccatggatgctgccaataataacgcgcctaatcttttcttcataattacagtcctcctttttacttgtctgtcaacggtcttacgtgtacgaatttcttatagcaatagtatatcagcggcctatgtgtcccacaattctgtgagattactatttactccaaaatattacggaatttgttggtattgtccaataaaataaagactggatatgatttttcgtcatatttccagcctttttcatgattccacaaaatccttttatctcttattacggtattccaggggtgtcatcccatacattttcttaaaagtgctgctgaaatacttggcctccttgtaccccaccatctcagccacatccgatactttatactccacatggttcagatagttcctggccttcatcatcctgtactcagttacatactccatcaggttcttacccgtatggcgtttaaaaagctcgcacagataattaggggaaaggtgcagttcttccgacatgtccttcagcgttatcctccctccgtagtgtacctccacatactggatggccttttgcaccaacaggtttcccacgccgtccccgtctgccccggatccggcttccccctcctgaggcggctgcttcttatccggcgcatcccctgcgccctgcttcagctccttctcgatgccctccagcaccgcaaccagttcccttggattggtgggtttcagcagatacctggtcactcccagttcaatggctttctgggcataagcaaaattactgtgtccgctcaggatcacgatatgtatgtcctggttcctctcccttatctgccggatcagttccaggccggatacctccggcatcttgatgtccgtcacaatcacatccgcctcattgtcatagagtgcggtcagggccgaaagggcgtcctcaaacactccggtaacctgccatccatccctggcccccaggagtttcaaaaggccgttcctgatcttcggctcatcatccacaatcatcaatttcacgtttcaatgttcctcccctctcccaatacacggcttatccggccaggtctggtcctttatgccctgcccggcctgatgtccaacctgatatctgtcccgatgtccggcctgatatctgtcccgatgtccggcctgatatctgtcctgatgtctatcccgacgtctagcctgatatctgtcccgagttttcttttggtatcctcagatgtatggacgtcccttttccatacacactttcaatccggatgcggtactgctccccatagtgaagccggatgcgcctgtccacattgcgaagtccgattccggtgtgtccttccttctccaggtccggcagttcctccttcaggtggttaagctgttccggcgtcatccctatcccgtcgtcctccactgtaaccagtatctcgtcccccgcatcccttatgaggatgcttacctttcccttctgcttgcgcggctctatgccgtgggtgattgcattttccaccatgggctgcagtatcagcttgggtaccttctcctggcgcagcctgtcatccacctgcacctggtactccagcttgtcctccaggcggtttttctgtattttcaaatagcttatcacatattccacttccctgtccagaggcacaaaggcgttctcgtcctcgatgcagtagcgcatcaggctgcccagggaaatgatgatgtcgctgatatcatactcctccctgtcaatgagcatccagttcactgaatccagggtattgtacaggaaatgcgggttgatctgcgcctgcagcgcctgtacctccgcattcttctgcgcaatcttctcctggtagacctggcggatcagggtattgatcttgtccaccatgtagttaaaggaatctgtcagttccccaatctcatccttcctcctgtttggcacacgcaccgtgaaatccccttcctgcacctggctcatggccacgcaaaggcgtttgatgggccttgccatggcatagaccagcaccgcaatcaccagggcaatcccaatggtgcacatcatcaccaccagccagattgcgctgcttaaatccttggcctgggggaacaggccttctgccgggattgcggaataggacttccagccagtgaccccgttgtactggccgcagacataatattccttccccctccactccaggtcaaagcggcggatcccccgctcaaacctgtcgtcaatctcctcctgccatcccttgtccaccttggggttgctgcatatgacctcccccttctggtccacaataaaaagatactggtactgaaacagcccctggttgcccagcagcaggttgctgaacatatccggatccagctcaatgaccatgatacccagcacccggtcctggcgttcatccataatggccctggcgaccgtcaccacctggcgttcctgctccggacctgcaatcagggcaggcatgattcccgcccacacggccttattgtgcctgtcccctaccgcgtcataatattcggccagcatttcccctgacaggtcccctggacttacccggccgttttcccccgtggtatataaaatcccggactggctgataatggaaatgtccatctgctcgccaatggatttaatgaggctggagcaatagtcgtccaggtaggtcctgcggatgctcctctccccctggtcccatcccgtcaggcaagcgccccgcaccagttcgctgtccgccgcgttatccagcacctccatgatatagcgcaccttcacattgatgttgatgtcaatgcggttaatggtatccgacatctcctgtttcttgttcttcaccacgatatccctgctgtggaaataggaaaatcctccaatgagggcgccctcaatcatgaccgtcacgataaataccagcgtaagctttaagcggaatgacatatgtcccataacccgttcctccggatactgttcatttgatactgcagcatgcagttcctccatcctattatagcagagataggcgccggattcactaggaagaaataatacctccagatctgcatccacacctgtatccatacctgcatccacacccgcatccatacccgcatccacacctgcacccacacccgcatccatacccgcatccacacctgcacccacacccgcatccataactaaatcaaaaatcccccggacatccgcaatgtccgggggaagcatatcattcatatcaatcctgtaacctatccttatcccaatcaatacaccaatcctaatgcccggcgggaaatatcagctcctgtatccatctccgggatgattccagcggttttcctgggtatcgtcagaagcaggatacctgccggatgtactgtctccaggggtatggtcagcagaaggaccgtcagccgggaaattccctgcatcctgtccggctgtatcctggctgccttcaaccggatcctgcccggccccattcccgcctacaggcgcctgttcctgcgccctgtactcacggcctgtatcttcatcctctggcatttccccagcacgatttcctgactctcctttggacctatcctccggcttatccacagccttgtcttccgacttctcctccggctccggtattccctttaccttgcggaaaatctgcatgaattccttacctgtaatggtttccttctcaatgaggaatgccgcaatctggtccatggcatccttattatcgctcagcaggctgattgcctcgttataggaatccttaagtatcttcatgacttccttgtcaatctccgccgccgtggcatcaccgcagtttaatacattgcgcccggtcaggtactggttctcctgtgattccagccccatgaggccgaacttctcagacatgccgtactgggttaccatggcccttgccagattggtggcctgctggatatcattggccgctccggtggtgactgtctcaaacacaatctcctctgccgcccgtccggccatcagctcaaccagccttgcctggagttccttcttggtattcaggtacttctcctcctcgggcacgttcatcacatagcccaaagcgcccatggtccttggcacgatggtaatcttctgtaccggctccgagtgcttctgaagggcgcttacaagggcgtggcccacctcatggtaagatacgatgcggcgttcctccttgctcataatcctgtccttcttctccttacctaccagcacaacctccactgcctcgaacaggtccttctgggacacggcgctgcgtccatgcttaaccgcattgatggctgcctcattcatcatgttggccaggtcggcgcccacggcgcccgaggtagccagggcaatatccttaaagtccacactctcatccagaagcacatccttggaatgtaccttgaggatgttgatacgtccattgaggtcaggcttatccacgatgacacgcctgtcaaaacgtcccggacggagcagggccgggtccaggatttccggacggttggttgcgcccagtaccagaagtcccttggtggaatcaaaaccatccatctcggaaaggagctggttcagtgtctgctcacgctcatcattgccgcccatacggctgtcacggctgcgtccaatggcatcaatctcgtcgatgaaaatgatacagggcgcattctccgttgcattcttaaacaggtcacggacacgggaggcgcccacacccacgaacatttccacaaagtcggaaccggacagggagtagaacggcacatgggcctcgcctgccactgcctttgcaagcagggtcttaccggttcccggaggtcccacaagcagggcgccctttggaagctttgcgcctatcttggtatatttgccgggattgtgcaggaaatccacaatctcggtcagggattccttggcctcgtcctccccggccacgtctttgaaggtgacgccggtctccttctgcacgtacatcttggcgttgctcttgccaacgcccatgattcccccgccgcccatgcgcttcatggtgaaattcatgaggaacagcaggaacaggaatgggaccgcataattgaggagtaccagcagaagggtattggcgtccttgttttcctgatgtgtctccacattattatccaggaaacggtccacgaacttataatcccccggcaccttcaccacatagtaatccagatcctgggaatacttcgtattatccttctttggcacgactgtaatctcggtgccgcctatcttgatggattccacttcgccgccgtccaccatcttgacaaattcattgtaggacagctcctggcgctttttggaattcaggtaggagttcatccagctcaccagtccaaatgtaagcagtgcagcaatcagcagcatggtgatggtctgccagttgctcttcatattcggatcttgtttgttattattatccatattgtacagattctccctctgaatgggcctatctatcatttaccaacaaaaacccattctctaccattatagtgtcagtctccccataaatcaagaaaagaacaattaattttcttaaatttttacaaaaactcctagatttattttacatgccgatgtataatgtatcagttatttttttgatactatcaacacagacgtcacacaaaccaaaaaggaggtatccccacatgccagtcaagtacgtatttgttaccggcggcgttgtatccggccttggaaaaggcattacggcagcgtccctgggccggcttttgaaagccagaggctacaaggtaaccatgcagaagttcgacccctacatcaacattgaccccggcaccatgaaccctgtccagcacggagaagtgttcgtgacagatgacggcgccgaaacagacctggaccttggccactacgagcgcttcatcgatgaaagccttaccaggaattccaatgtgaccacgggaaaggtctactggaccgttctgcacaaagagcgccgcggagacttcggcggcggcaccgttcaggtaatcccccatattaccaacgaaatcaagagccgcttccaccgcaactattccgagacagaaaccgaaatcgccatcatcgaggtgggcggaaccgtgggcgacattgaaagccagcctttccttgaagccatccgccagttccagcatgaagcaggccccggcaacacctgcatcatccatgtgaccctgattccttatctgaaagcttctgaggagctaaagacgaagcccacccaggccagcgtcaaggaccttcagggaatgggcatccagcccgacatccttgtctgccgctctgaaaaacctctggacaagggcatcaaggacaagattgccctgttctgtaacgttcccccccaccacgtcctccagaatctggatgtggacgtgctttatgaagttccccttgtcatggaaaatgaacaccttgcccagtcagcctgcgaatgcctgaacctgccatgtcccgaacccgacctgaccgaatggaaggatatgattgacgcatggaaacacccggaaacagaagtaaccgtggccctggtaggcaaatacatccagcttcacgacgcctatatttccgtggttgaggccttgaagcacggcggtgttgccaatcatgccaaggtcaatatcaaatgggtggactcagaacaggtcaccggtgaaaatgctccccggctctttggggatgtaaagggaatcctggtgcccggcggattcggcgaccgcggcattgacggtaagatatacgccatccagtatgcccgcgaacatgggattccattcctgggactctgcctcggcatgcagctttccatcgtggagtttgcccgcaatgtaatcggattcaaggacgcccacagcgttgagctggatccttccaccacccacccggtcatccacctgatgccggaacaggatggcatcgaggacatcggcggcaccttaaggcttggttcctacccatgtgttctggacagatcctccagggcatatgaactttaccaggatgaaaccatccatgaacgccacaggcaccgttacgaagtaaacaatgattaccgcggcctgcttacccagaacggcatgaagctgtccggcctttccccggacggacgcatcgtggaaatgattgaaatcccatcccatccatggttcatcgccactcaggcccacccggaactcaaatccaggcccaaccgtccccatccgctgttcaggggattcatagaagccgccctgaaagcatgatcagattcatgaatggttcgataaatgcatgatcagataaacgcgccatgacagacaggccggaacagcgaacaggcagcccttcacaccggctgcctgtatcttccccttaactccatgccaatcatatattttccagtataacatcactcccgctgcacaaactatccctaaacacaaagcggaggtaatgccatgaatgaaccagaaaacaaagcacaggacaaagatccctttgacatagacatccaggcctgttccaccatggactgcaccggcctgattccctctttgccccaggacgaggcggagcaggaggcatatgaggacctttatccctatataacaatggcggtaaaggatgaaggggatgcggagggatgaatcccggatgcacccatctgcaagggataataaagggatactatgggaatgcggaaacccaggagcttctgcacggaatcatggtatcccaagaccttatcatatacgttaaggggaaaagcaccctggccttaataacaggcctggatacttttccccttattttttaatgattgagttaatgattgagtcagaccgtatatcagccatgcatgaagcggctgaggaattcctgggtctgcctgtccttaggcgctccgaatatctgttccggtaccccttcttccacgatgactcccccggccatgaataccacatggctggatacgtccctggcaaatgccatctcgtgggttacgataatcatggtcaggccttctccggccagcttgcgcatgacctccaggacctctcccaccatctggggatccagggccgaggtcggctcgtcaaagagaagtacctccggctccattgcaagggcccttgcaatggctaccctctgcttctgcccgccggaaagctgtcttggcttggcattgatatatggcgccatccccaccttttccagatagtacatggcgttcttttgggcttccggtttattctttttcaggaccttggtctgtcctatcatacagttttcaagtaccgtcatgttgttaaacaggttaaagctctggaataccatccccaccttggagcggtactggggcgcattcaccttcttgtccgcaatgttggtgccgtggtagacgatctcccctgtggtcggtgtctccagcaggttcaggcaccgcaacagcgtggactttccggaaccggatgccccgatgatacaggtaacatccccgctgctgactgaaaaatcaatatccttaagaaccaggttggtgccaaaggtcttgctcaaatgacggatttctaagatattatcacccttcatcccgcatcctccttattcttggccttatcatccgggaaacggtacatgccgctggtatacgccagggtatccgtggtggccaggtcgaagttgtccgccccgtccatccggttctcccaccagcgaaggatcctggagcaggtaaatgtcatgatgaagtacatgatcatggtaatggtatatgtctcaaagttcatataaagagctcctgcagcagcctttgtcttgtacagcagctccgtgacaccgatgacggaaagcacgcagctgtccttaatattgatgatcaggttattgccgatctggggcatgatgttgcgcagggcctgcggcaggattacatatatcatggtctgcacatgggtcatcccgatggacttggcgccctcggtctggcccgggtcaatggaaaggatcccgccccttaccgtctctgccatatatgcgcccgtattgatggagaggatgaaattagcagctccccacatggacatatcaatgcctaacagaggcagaagcccgaagtagatgaacatggcctgggccatcatgggcgttccgcggaaaaattccacataagcgttgagaatcagctttatgatccaaagcagtaccctcttaaccggattgtctccctttgcgctgggtatggtctgcacgataccaacggcaaaaccgatgatacagcccaccaatgtaccaaccagggcaatcctcatgctgacgccggcgccctgcagcattgacataccatatttattgaatacgaccattacacggccgaaaaagtctgtaggcatatcctttctccttactgtcccttcgtactttgttgattaattagctaatggctgtacagagattgcctcatccatcatactggagaagtcatcctttgtcatcttggtaagtacgctgttgattgcttcctgtaactcagtattgcccttctttaaggaaataccgatgttgatatcttcttccgtcacctggaaatcatctgcgccgccgccaaactcaagcatcctgaagttggggtatgcaaccagcgcgcccttgcctgtgggctggtctgtcaccaccaggtcacatttatcagcgttcagggacatcagcatgtcaggtgcgcttgcagtggctgccagtacattggctccctcaatctgaggcaggcatgtattgtaccagatagtgctctgctgggaggtacaggtagcgccagccaaatcggcaacgctctttgcatccgcgtacttgctgccttcctttaccagggtaacaatggttgcgtagtaatatggctcggtaaagtcaactgcctgaagacgctcggaggtgatggactgtccggcaatgacacagtcaaccttgcctgtcgtgacggccggaatcagggaatcccaatccagacggacgatttccaggtcatatcccagttcctcgcagattttctttgccatcatgacgtcgtatccgtatgcgaactcattgctgtcagcaatgggtacagcgccgttggcgtcatcgggctgtgtccagttatatggcgcataggcgcactccatggcaacccttaaggtcttcttctcaccggatgcttctgctgccccggcgtcactttcaccggatgcctcggttgctgctgctttgtcatcctgtgcctgggttgctgctgcagtggtatctgccgtaccgcttccgccgcatgctgtcagggaacctgctgccaggacgcctgccagaaccatgcctaatactttcttcgcattcattttcataataatctctcctctttgattgaaactatgccggtatggctgtctaagaaaaaagccacacccatccacacaggtatgactccaatgtcatctgatgaccggcaatctcttaaacagtttaaccttgccctattatccctcgcacactttattttcttaaataaatgtgcctaacgtgctaagtatagcataactcgtcctgatttccaatacctatttatgcttttttatgcgtaaaaacagtataaatatttgtaaaaacagccactaatccaccaatttggatttgtggctgctgaaaatcagttcttctgcccttcattcccttgtgctgccgcggaagctgcctgggccctttccttcatcaaatcatccatcttctggaggaactgcgcgtccggcccaatctcattgccgtcctcatccacctccactgcaaacaggaaggtcctggcatcattaatctcatagctgcaggtaaccagggtataaaccgtcttagccggatatgtaacgtcctctgcaaaggaacagggcttaatcatctcatgcacaaacgcatcaaaggattcctgggacttgaaccgtgtcttgcgcacaatgggctgtgcctcgccgtaatagcaggcaaccgccttaagcctaatctcacggtccggcgtgtagatgctgaaatactggtgttccttaaaatattcctcatccttataatgaatcacatccttgaacatgcttccattcttcatgttatgtccgtacaggatgttgttgcggcccacaaaatccccctggctttcaaaatccaggtaaatggccccgccaacgctctctttcccataaaaatcatggttcagataaaaatcattgtccgtaccctggacaatggggtaatcaatattggtatccggtacctttatccagcctatggtatccgggttctcctccatcagatcctcaaaattaatgggggaaacatatggttctgtctcaggctctgtctcctccggcgcttcgggcgcctccgtctccacgggtgcggttgtctccctggcaagttctgccagccgttcgtactcctcctgtgcccgtttatcctccaggtagctgtgaaggcttaagcctccgctgaccagcatgactgccgccagcaggaggatgatgatcctgcgtaccctgcttctgcccttgttctgctccatctatccctgtctgtcctttccagttctgtccatgtcatgtatcacgcctataccgctgccgtcacttccggtccttcctcttcccatccctcgctgtaaatcactgcatcctgcatcaggagaagcatctccaggaagctgcggaagcttacctgacagcgtttttccttccagcatatggttccctgccaggtggaattccgcttgaagagtatgcggaccacgaatgtggcaggaccaaaattacctgtattgacagtcacggtcctgggtacgatcagattctcttcctctgccccaacaggcagggggttaagcatatatccaatctcttccctcaaatcgaactcattgcagaaatccatccgcttttccactgccggatgggagacatccccgctcatgacaaagtcctcataattgcgtacaaccacttcgcacatcttcttgccaaggccaaaggggttctccccgccattgtccccaagggtcctgctgaaatactccatcagttccaggaagcttaaaaaggaaaatgtcttcccatcttttaaattcctgatatctccctgccatgtggcgtggaaccggtactttacgtgaagcctgaattgccccagccttccctctgtccgtccttctttttcccctggcccgtcagatatatccctgcttttggcagacagggatcttttatggaaaatcctttgctccacactattcatcggatagtgcagtctgtcaaacatgctttctaatattaatgccatttcagaaaggctgcgaaaccgcagtccatgatccaggctgtcatgataaacctgtcctctcaacaggcgtccgtcaaaactatctatgcttatggtataatatttgtgtgactcctgcagtgctcctgttcgcgaaacagacatatattcacctacttttctatgaaatgttagaaaacgccccatttatcctgtcaccagtataacagtggccggttacattttggttacaaaacttccttttcctaaaactttttttgattttttttctggacatttccattattgattagtatactaaagtgtagtactctgtaatgcaaaggagaatcgccatgataacatcagcttcagaagaaaagcccacaatccatgtcaataccctgggcggtttctcaataaaggttggtgataaagagataaccgacaacagcaatcagtctaagaagccctggtgccttttagagtatcttgttgtgttccaaaaaaaggacatcagtcccaatgaactgataaatatcatatggtcagacgacccaggagtcaatcccggcggcgcattaaagacactgatgttccgttcccgtaagctccttgaaccactggggcttcctccccagaagctgctggtacagcagagaggttcctatgcctggacccaggaataccctacggttctggacattgaccagtttgagtccatctgtacccgggcaatcagccagccccacaacggggatgacatccttaagctctgccttgagggcctgtccatatacaaaggtgatttccttccaaaatcagaatatgaatcctgggtcatcccaatcagcacgtattaccactctctttatcagaagctggtgtataagacagtggacctgctgctggagcgggaggacttttcacagattacctccatctgccaggccgcagttggaatcgaaccgtttgatgaagaattccattactatctggtatactccctgtacaaggacggacacaccagccaggccattgaagaatacaaccataccatggatttattctacaatgaattctctatctccccatcggatcattttaagaatttatataaaaccatccgcagcaaggaacagggcatcaacaccaacctggattccatccaggaaacgctgcgggaagaggcttcaggcggggcattctactgtgaatacccggtattccacgacctgttccagctggaacgcagggccatagaacggacaggtgattccatctatctttgccttcttacggtcagcgacctggatggacatgtgcctaagctcgccatactcaacaaagccatggaacatctcaactatgccatacgcaattccctccggtgcagcgatgtgtacacgcgttacagcatcagccagtacattgtcctgcttccaacggtcactgccgagaagggtgagatggtattaaagcggataacctctaatttccgtaagcaatacaacaggaaggacctgcgtgtggaatttaaactccagccggtcctgccatgggaacgcagttccgagtctgcgattccactgtaaccatgacattcatatcaaggtaatatataaaagctgcggacattggttgccgcagcttttctaatgatgattccttatgcctttgcctttccgtaaaacatcttattcagactcttcatcacataccgatatgccggtatcaggaacaggtccgccgcaatccacgccaccggattggcaatacagactgccaggtagccaaacacaggtaccaggcagaagcccacaaaggaacgggccgccatctcacacacacctgccaggattgccagccttggatacccaaggccctgtatcatgaagcgcaccacattgacccccagaagcggtatgaagaacaggctgttggcaatcaggaaccactgtgtgttcctgagtatctccgtctcgcccggatccacgaacatcagggcaacccattcccccatgaagtagagtactgcaaatgccaccaccgcatagacacagcctataagcgttcccgctttcaggcctttatcaatacggtccagcttccttgcccccacgttctggcctccgtaggttgccatggtggaacccagggcgtcaaagggacagcagaagaacatgctgatcttactgcccgcggtcaccgaggccactgccatggagccaagggaattaacagaggtctgcaggatcacgcttccgattgccgtgatggaatactggagtcccatgggtattcccatgttgcacagtatcttcatataatggcggtcgggcttccactcctcctcatccatcttaaggatcgtgaacttcctgcgcatgtagacaaggcacaggattcctgatatggcctgggccgttatggtggcccacccggcccccgccacgcccatgtccagtaccaggatggtaaacagatccagagccacgttcaccaccgatgaaaatacaaggaatataagcggggtcgtgctgtcccccagggagcgtatggtacaggacagcaggttatacagatacgttgcagggattcccaggaagatcacgaatatgtagctgtaagccccctcgatgatatcctccggcgtctgcatcaggaccaggatgtcacggcagaaaaagcagacaacaaccgtcatgacaactgcaaatatggctgccagccatccgctgtttgccacgaacttcctgagcgccttcatgttcttttccccgaacttctgtgccacgggaatggcaaacccgctgcatacccccagacagaacccgatgatcatgaaattaatggaaccggtagagccgactgccgccagggccttcacccccaggaactttcccacgataatggtgtcagccatattgtacagctgctggaacagaagtccgaacagcatggggatgaaaaaccccagtatcagttttacaggcgacccttccgtcatgtcctttgtcgcactcttggccatatcttatcctctctgcttctatgaattcatctgattaatttaccctgtttgcatttattttgcaagtagaaaataatcaggattttatgggcagagcatacatttttaacaattatcccagaagaccgccgctactcgtaacagagtaccggcatccccttataaaccagcccgtaaagctcctttgccttggccgggggcaggttgatacatccgtggcttccgcttgtctggtagatggcccctccgaacttgcttctccagttggcgtcatggaggccgattcctccgttaaagggcatccagtaatccacatggctctcgtattcataggtgccgtccgctttcttggctcccctgagtatccggtccatctccttataggtcaggctgtagattcccgcaggcgtgttataattcttggcaatgttccctgtgacacagggcgcttcccacaccaggttcccttcctggaacatgtacacatgctgcccggtcaggtcgatttccacatatgtggtcccccagtcaggcgctgtgcggctggcggccgaggcggcatataccggttccctgtcctgctccccctctgcaagtcctgcctggatcagctgggtcagggcagcgctctcccccgccacatccagcctccatccgtaaggtccggtgatttccacgtcccggcctcccgctgtatggaatgtcctggcggtccctgccgtatcgtactttcctgccaggccggcgacaaatgccaccaccttctcctggtccaggattgccgtggttccctggcttcctgtaatccagctgcagatagtctctcctgtaagaggttccttcacatccccgaacacataattgatggttgcgttcctgtaccggttcatggtgtcgcacagggctttcagctccccgctgtcttcccgcacattgacctggtaatagcatccggcctggtccacgtccacggatgcctgtcccgcctttaccgctgcctcaatcacgcttatggtcttatcctcatccacattattaccctgcaccgaagggatgatggtaaagggcttcccttcctcatacgcagagatgcgggcatccattgtcactgtgataccggaaccgcttataagggataacgcctttatccttgccgtcagggcctccgcgtcataggccgccgtcatgtccatggtatgggagttgtccgtggacggacccgaattgcggcccgatgcattctgggcatccaggatggcctgaagcccttcgggaaccgttaccttgtacccgatgtccgtacccttgattgtttcctctgaacccccgcgtctgcggatggttaatgtatattcgccatcataaaaaccttctatcctggtttttgcctcatctgttgtaagaccgccgattcccacgccgttcaccctggtgccgggcacgaatctggatgtatcagcatcctggtctgcaagggatgtcactgcaaatgcagctgcaagggccgctgctgccaaagccgtcacgaacatcctgccaatggttcttcctttttctgatttctgcataaattaaaccccaatcttacttctttttccagaattaccccattggggcattctgccttcttaacataacaaccttttagcataatttcaaccggttaatggaaaatgtaagaattaattaatgataggttaggatttacctaagaggaaagtaaggcggggatggcgtcctgcatcaaagcaggaatccatccccgtcttttgtcctcttaatcaatcacttcaacactctcaataaccggctggttttcccttgccacggtaccgttgttatcctctaccttggtgtccccgcagattgcatccactacctccatgccctctgtcacataaccgaagcatgcgtattccccgtccaggaacgtgctgtcctcatgtacaataaagaactgggaactggcgctgtcctttatctgcgagcgggccatggatatggctccccttgtgtgggataaggggttctccacgccgttgctggcaaactcccccttgatttcctcatcggatccgcctaatccgtttcccaggggatcgccgccctgaatcatgaaaccgtcaatgatgcggtggaaggtaaggccgtcataaaagccttccttggccagcttcaggtaattcgccactgtaatcggcgccttgtccccgtccagtgttacggatatggtcccataatccctgaccgtgattttcacatgatgctctccggccgctgcctccaggtcttcaggtgagatccagctgtcccctgcctgtccttctgtgcctgtggtctcttcactgcccgcctgttcctttgtttccgtcttcgtatccgtctttgtttgctccttcgtatctgcctctgtccggctttccttctccgcttttgtggtctgggccaccgcatcactgctgcctgacctgccgccgcatccggccagcatggaaaccgccagcatggctgtcacacatacgcacatccattttttcatcataactgctcctctttcatctggaaccgtatatcaccgccataagccgcatgtcccggcacatcccgggcctgttttccaacacgccctgcagtggaaggttcctggtattaagcatgaactgccagagcatattgtaacatccaaaccttgtccacgtaaaggactttatggaattatcacattttcatcacatttaccgttcccgtatcctttgaggataccttgtggcacacataggtgagcgccatggtggccgccatgtccggcaatgtgttccccaccggtgtatccacctgcatcaaaagccggtagaggatgaatccggccagccatataagcaggttcctgacgcaataggcgtccctgctgcagtccttgccaagcaggaaatagtcggttatctggatggcaatcatgggcgcgaacacggatcctatcagatagaggaagcccgtgatattgtccatgggaaatgtgacggccgccgcggtacccaccaccgtcactgccactgccgcccatttttcctttatggcggaagagatggatacactggataccccggctgaatatgcgtccaggaatgtggtggtaaccgtggacagcaccacaatcagaagtccggtaaggcccagtcccgcctttaccaggatgacggaaatatcatactcccctgtatggatggccgcccccataccgattacgtacatgaaaatgcttacgataccatacaccgccgcgctggccgccgtggcggcaaagggcttttcagtctccctggtataatcgctgatcaaagggaaccaggacaggggcattgccacggacagctccacggcggccccgaagctcatggtcccgtctgatatgccaaccgccgcgccatggcctgcgaatatgacacggcacaggataagggtgaggatgaaaagcgcccccatggctattacgttgattttccccaggttctggattccaatcaatatccatatgaggattaggccgccgatgaccaggcaccagacccaacggcccgccccatagatgcctcctgccgccagggcgccgtcgtatatcatgatggaggtccatcccaccagctgaagcacattaagcagcacaaacagaaggctcccccgctccccaaaactcatcttcacggtttccatggcgctctttcccgtatacccgccaatgaggcccgccaggaacagaagggcgcagccaatcacatgtcccagtatgatggctgccagccccctgccaaatcccaggggcgcaagatatgtacctgtcagtatctccgcaatggacactccggccccgaaccagattaagccattgctgaatacagaagtcttttttccgctcatatccccgcctccttaatattcgccacggatggcaaatgcatggttcatgggaccgcttccctttcccaggtcaagcatcgcagccagggcgccggacagatatgccttggcccgttccacggccaggtccatgggcatcccctttgccaggttggaggcaatggcgctggaaagggtacatccggttccatgggtgttgggattgttgatccgctttccgtaaaaccacttagcctgcccgtccatgtacagcaggtcattggcatcgttctgctgatggcctcccttgcacagcacggcgcatccgcacctgtccccgatgaggcgggccgcctgttccatatcttcgggggagtttatcttcatccctgacaggatttccgcctccggcacattgggggtcagaaggtccgccatggggatcagcctgtccttaaggacagtaaccgcttccccgtcaatgagcctgaatccgctggtggctgccatgaccggatccaccacaatatgggacgcatgatagaaggccagctttcccgcaatcatctcaatcagtcctgccgaggaaaccattccgatttttactgcatccgggaagatatccgtaaaaatatcatccagctgctcacccagaaattcaggtgatacttccattattcctgttacgccggttgtgttctgtgcagtaagggccgtgattgcgctcatgccgtaaaccccatgggctgtcatggtctttaaatctgcctggatgccggcgcctccgctggaatcacttcctgcgattgttaatgcagtgtacatagtcattctccttttcgcattaattttcttaggcggcagaaggtggtgcccccgatctgccgccgggccataaagtaactgaaacggataccggcctcgtgcaggcgcgccaaaacggcggtacaccaaaacaggtgcaccgccggcatataatccctatggtccctacgttggcattatccaaatcaggtaatgggtctaggcatgaacagcctactctcagcccacttaagtgagctccccgttgtctatttacaaatcctattataactcgtaatcaggaaaaagcaatctgtttttccatcccgccatgatggccgctgcaatccttatcccggcctttggccagctatcttatcatcctgtccacgattttaaccatggcggtaaatgtggcgccgtcataatccatgtcgaattcgtcccccgggtggtttaatatcctgcgtatgctgaggattcccaggccgccgtcctttttgctggaaaggatcctgccgccgctctgctttatctggccgtcataggaattttccaccatcatcatcaggtggtcctccatccatctggcctggatgcggacgaaccgttccgtttccaggcgcctgcatgcctcgaaggcattttccagaaggtttccgatgacaatgcacagtgtcaggtcatccaccgggacatgggccgacaggtccatcctggcctcgaaatcaatccggccctgcctggcccttgctgcatattcctgaagcaggccgttgacagcctggttctggcagaataccatgtcggccgcgcggtccagctcctccttcaggttctgaagataccgttcctgctcctccttgcccatgttctgcagcgcatggatgtgatggcggaaatcatgcttgatgatgcggacctgttcgatataatccagtgtctggttatagtgctccctctgcttgccgatgagctgccttgcaaactgcagttcctcctccgtcttcctgcggcatatgattcccagggtattgcccaggatcatcacatagagtaccaggatcatggcgcaaagggcaaggaagaacaggatgtcctctatccccctgattgccagggacctgggcgagaatatggtgttggtgccgatgaacaggacgagcagggatacggacggatacgtaagcagcagggaacaggaacgtttagagagctgtgcaaaaaggcgctgcaccgtatccttaagaaagtaacggacaaacaggcagaatccggctgcagagaccagggacactaccacggaaatctgcccataggtcaggctgacccggttaagcagcagccaggccgcgaattcattcagggacgtggacagcactgcaaaaagccaggcggatatgtagaggaatgccttttccagcaggccgccctggaagaagataagcagcacaagaaaaaacaggcaggaaaacacaccctgaaatacaaaaaacacctgcggcctgatatggaacagggactgcatggataccatgatgacccacagataggcggacacggccgcgatattttcccggttcctgtgttttggctccagacatacaaagatgggcatcatgcgcacggccatgttgatcaggttcaggataatcgtacatgcattgtcgttcataggaacctcatttcagcctgtgatggtaatatgcattcttgctctgcttgtaaaagttcctggatatgggaatcatctggccgtccttcatatagaagcaggaatcctccagccgttccacctgttccaggttgaccagatagctctggtggcagcgcaggaaccccgggtatccccccagttcctcctgcagttcggtcagcttctggtggatggaaatcacttccccgtccgtaagggttacaaagacccggtgaagccggttctcaaaccatgcaatccgttccagcttaagctgcaggggcacgcggttatgtaccacggatatacaggcgtcatccccacccaggcgctgctttaccacccgctccatggtggcctcaaagtcctttttccccacgggcttcaggatgaacccggctgcattgacactgtagccatccaccgccgcttccagggacgaggtgatgaggaccaccgggctgctcccttttcccagacgggcagctgtctcaatgccgttaagcccgggcatcatcacatccagcagatacaggtcatactgcttcccggattccagcagtccggtcccgttcccatatgtatcaatctgtacttccctgccgcgttccctaaaaaaagcagatgtataccccacgaccagggcgcattcttcctttgtatcatcgcagacagcaatcttaagcatccttcatccccctccgcctatggaaccaggcgcctgtccgtaatatcccccgtacatttccttctattttatggtgattcctcccataagtcaagttctggcggaaatgtcatatttggtatattttctgcagaaatggtcattaagtacacaacgggtttatggtacacttattgtaagaaaattattacaggagggattttatgggtacaaacatcattgtaacaatcattgtaatcgtctacctgcttttcatgctgtggatcggatggtattcatccaccaagatttccaccaacaccgacttcatggtagccggacgccgccttggaccgcttctcatggcaggcaccctggcagccactgaaatcggcggcggaagctccctgggcgttgttcagaacggtatgtccggctatggactcagcgcttcctggtacatcaccaccatgggcattgcattcatcatcttaagtttcattgcccccaagttccgggcagccaccgttaagacggttcctgagtatttccgcagacgctacggcaagtcctgcggcatcatcacagccatcatcatgctgctgcccctggtgggtcttacagccggacagttcattgcatccgcagtcatcctgtccaccatgttaaacattgattaccaggtagccgtcatcatcgttgccgtggtggttaccatctactccatcatgggcggcctctggagcgtcacgctgacagactttgtccaggtattcctgattgtgatcggcatgatcatcgctgttccgtttgccatgaattatgcaggcggctggggacagatatccgccaacatcccggcaggcaccctgaacctgtttgagggatatgacctgttcgggatcatttccctggtcatcatgtacacggccaccttctccgtgggccaggaagcggtgtcgcgcttctatgccgcaagggatgaaaaggctgccaagggcggcgcatggctggccgcgctggtgaacttcatctatgcgttcataccgaccatcctgggtatcattaccctggcattaatcaatatgggcaagttcagttccgaccagtttgccgccgttggcgcgcgttacgcccttccggtacttgccatcaataccatgcccgccatcatctgcggcctgctgtttgccggaattatttccgcaaccatgtccagttccgactccgacctgttaggcgcaggctccattttcgccaatgacatctacaaggccgtgttaaaaccggatgcatccagccagtccgtcatgagggtgaccaagattgtcatgtgcctggtgggtgtggcatccatgctcatcgccctgttcaacacacagagcatcgtatccatcctgatgttctgcttcaccctgagggccgccggttccttcttcccatatgtaatgggacactactggaaaaaggcttccaccgcaggaaccattgcttccctgattgcgggaaccatcgtggttgtatacctggaacatgtatccaagggaatgctgttcggcatcaaattcagccagcccatcatcccgggccttgtggcggcattcatctgcttcatcatcttctcctatgccatgccgccgaaggttgaatccacggaactggcgccggaagaggatgactgataggaaataacgtatcatataaacaagaacagacccggcgccgtcccaccctttgaaggtttgggacagcgccgggtctgtcatgtttatccggggacggacggtcatggtcccaccgtgaccggtacccccaggttacagtattcccataatatatccatcacgtcgttggtgacggcaatacatcctgccgtaccgcccccctgctcgccatgtatcatgatggccccgcctaagggcgtatcccagggcggctgctctcctgccttgttggcatccacgattgccttgtactgctcctcgttaatcagcccgtcggccaggccccgctctgcgtcgtcgatgttgggataggatagccccagggacagatagtactggctctggtcattcttcgtgcacacgtagaacttgccggaaggagttatctcatccccctgctgcaccttgtcccctgttgcggactcccttccaatctgggccggccagcttccgatggtggaattataacggctcagggtgaccgtgcttccctttttgcttacatagatactgataccgttcacggacggcctatagactgcccccggtcctgtctgcccagccatggcgcttacagggcctgataccgccagggccagtgataaaagcccaagcccaaggcatttacggatgttcctcatgtctgttctccttacaaccattttttacctgacgccattataccatatggacccggaaatggaatgcaagtaataaaatcgaaaggaaatcctaagcatttatttcctccccgtatcccagtaacggaagcacatccatggggtagtccaggatgaccagcgcagcctccttatccagatagtgttcctgtttgtggatgatcacgatattgcgtcctgtaaaatactcaatatactgccggaatacctcggaggccagggtggttcccagaagcagcagggtatccgcctttgttatctcaaccgtggtcttggtcatgttctggctgtccaccatctccccaatcagggaaatcatgggcctcacagggatattgcaggatggacagatcggtacgcgcctggcctgggctatatatgtaaccggatatttcttcttgcaccttgggcactggttctggtaaatgcttccgtgaaggttaatgacatgacggcatcctccccttcttggcttgtcatagatgttgctgtctatgatgcactgaagcttccccgcccgctccatggcggccagggccggaccggatgccgtatcccttggggcgttatggagcatttcctttttataaaactcaaagaactgttccggacgcgtattgtaaaatgcgctggaatacatttcctccacaccatagccataacggttttcaatgtcatatgccttatcctgcttcttgattcctatgaatcctccctcttccatcatgccggaaccacagagcgctaccgtatagttgctgtcatccaggatcttcctcagctgttctatcttcccgttcatagtgatacctccctttagtccctctcccggcagtgccggaaggttaaccattgtcatgtattatcactattatatatttttttccagattattaccacatttttccgcttatttttctaactattatgattgtttttccatattttctttcttttccacatgggaatagagcaatacgcccccaatggtaaccgctccccctgctatctggaggggggccgggacctccccaaacacgaacagggcaatcacggccgccaccgccggttcgcacagcttggaggctgacacaaaggacggggacaggaacttcaggcaccagctgaatatactatggcccagaagggtggagcagacactgagaagcagtcccacgatcacggaccgcgccccgtagccggtaaatgcaagcccgctggcagccgtggcaatccccaatgccagggcgcagaacacatagacgatataggtgtatacggtagtcgacatatgcccccttgcctgccgtccaatcaaggtgtacacggcgcagaacacagccgcggccagggccagcatgtcgcccagcagatgattcccgcccgccgagtaatcggaaaaggcaatcagcaggcttcctcccaccgtgacaaagatgcttcctgccgctgccagggaaatccttcccttcaggaacaggcagtaaccgattgccacccagatgacctcggtgcacacaatggcagtggaactggccacggaggtcttgttcagggactcaaaccacgtggtaaaatgcatggccaggaacagtccgcttaaggcgcacaaaagcacggacttcctgtccgtccccatgagttcgcgcctggactccccccgtccaaagacaaccggcgtcatcaggaccacggtccacatcaggcggtaaaaggccgttaccacggagggggcctgggaatatttaacaaaaatagccgataatgagataccggctattccaattacaatcatgattaacggatgtttttctaagaatttcatcttgggtacctttgcctttgctggtttatccacgttattctaccacaggaaccaggccgcgtccagaccctgtcttatcctatgcctctttatccgcccggatcagcctgcggaccgcctcaacggccaccttgatggctgcctccgtatcatggacaatggggttatccagcccggcagcctggcgctcctggttacccaccaccaggaaatcagaaccgcagcgcaccctcagatggctggcagcaacgaacagggccgcggattccatctccgaagccttacaccccaggcgcttccatgcctcccatttgttcagcagttcataacctacaggcatgcgctggggctcatgctgcccgtaaaatgcatccttgcactgtaccacgcccgcatgataggtatatcccagggcttttgccgcagaaaccagggcattggtcacttccaggtccgcaaccgccgggaactcgatgggcgcatattccctgctggtgccttccatgcggatggctcccgtggcaaccacaatatcaccgccctttacatccatctccattccgccgcaggtccccacccggatgaatgtatgggcgccgcaaagcaccagttcttccatggcaatggaggcagacgggccgccgattccggtggaggtcacgctcaccatctcaccgtccagatatccggtgtatgtaatgtactccctgctgtcggcaaccagcctggcatcgtcaaagtggctggctatcctggcacagcgcttgggatccccgggcatgatcacatacttgcccacatcccctttcctgatctgtaaatgatactgtaaaccctcttcacctgaataattctgcatgatattccttcctctctttccctttacttttcattccagcctgtcttttcaacttgtatatgtataatatcattttacttgtctattttatagttgggattttatacaatcattccagacggtttttgtacattttcacaagtatctcgcggttatatttggattttaccttgttatcattcatggttttacttttatacaactagacatgtctattttattgacaaaaaaacgttatggacttatgatgtttgataagaacctgtatactttattagacaggcagacaggagatgacagccccatggaacaggatgaggtaagtgggaaggtaaagaaattaaagcatgtaaaagtatataaccgtctgtattccatgatacaggacggggtctatcccccgggcagccagcttccctctgaaccggaactggcacagcagatggatgtgagccgcatgaccctgcgcagggccctggcccttcttcaggaagacgatctggtcatcaatataaggggaaaagggaattttatcaatgagacagacccggatgcggcccttcccggcatggaaaccatccagcatccggtccttggggcattggccggtacaatcagcgaaacggaactggaattccgcatcgagccgcccacggaaccaatcatccagtgcctgaaacgcaggactcccgtggtcgtgattgccgaccgctggtacaagcaggcaggaaaagcctgcgcttacagcctgagctttgtgccggttgaggtgatttctgaaaaacagattgagttaaacggcaaggaggatttattccagtatctggaacatgactcctaccaggatgccagccacagtacctgccagttttcctataccaccacaggtaattttaccgccaccaaatacctgctgtcccagcacccttcctttatcctgatacaggaaaccctgtacgacagaaaccaccgggtcctggtatccagtaagcactatatcccggtggaactgtttaagatgcagattaacagcggtgccggacacggcccggacggtgaatgaaaacagactgccccggtgtgcaggggacacggattctcctgtacaccggggacatcatacatccaggttattcttcactgcaaatacagccagctgggtcctgtccttcagcttcagcttctccaggagacgggatatattgttgcgcacggtcccctctgccaggaacagccctgccgctatctccctgttatccatgccctgggcaaccaggcgcatgatatccatctccctgggcgttaagtccaggtcagctttggcccctggcaatgccatctgacggcgcatgccctcaaacacgcttccgccgaacacgcggattcccgcgcatacagccttcacggactgtatgaccttgtcatcctccatctccttaaggatatatccgtccgccccgccctgcacggcggcgtccacggtttccctgtcgtcaaaggtggtaagcaccagcacccgtatgtccgggaaatccgccttaatcctgctaatcccatagctcccgtcatactggggcatgcgcatgtccatcagcaccacgtccggcttaagcttcctgcacagctgccacgcctccctgccatccgctgccagccctgccacctctatcccatcatcctgctccaggatggctttaagcccctgcctcaatatctggatatcatcagcaatcactgcttttatcataccgtatcccccttattcccttgtattcatgccgcgccaagcggcagccggatgtaaatctggaatccttccccattgccggatataatccggacagtccccccagccgcttttatcctctggcggataccgcgcatcccattgccttcctgtatctccccgcatcctgtcccattgtcaaaaatatacaggttcaggcagccgctgccaaatttaaggattacgtccatgtgggtggcatgggcatacttgaggcagttggtgacggcttcacgcagacattcatatacaaccggggaaaggtgggaatatgcctccctgtcctccccctgtatctccacctccacctcaaactccttcacgctttgggccagctggtacacgccctgggttatcaggccataggacgaggactgcctgagattgttgatggaacagcgcagttcccggatgccgttgcccgccagctcctgggcctgtctcaggtactccgggattccgctttcatccgtcccggctgcctttccgccattttcatattcaatgcgtatcagcttcagcagggaatttatcatggtaagggtatggcccgttgtatcatggacctcctgggctatgcggttgcgctcctgttcaatggccagcttctggttggacacagccagttcctgctcctgctccagaagctggtaatatttacccacatcagtaaacatcactgccccggcaatgcttttccccttcctgtccctgtaggcataacgcttcacctccagcttccggccggacggaccatcccccagcgtcatgacccgttcctgtccctcccctgtttcctccgggctgattccattttccctcaatatcccccaaagcgcatccatgccgtccccggccttcagtccgaaccagcccatggctgccccattgcagtatgtaaccttttccctccggttgtacaccaccaccccctctgcaatggaatcaaacatccggtcaaatgccatggtattcacatccaggaaatcataccggaacacggccagcagcatcaggatgctggacagggcaaatgcgggcggcgtcagatcgaacccggattttaccaggcccgtcatatagagcaggttaaacccaaggggcactgcggctgataaaagaatgaccgcaatatgggacagggcaacggcatttttcctgaatgccgtcagcaccaccgccatccccgccagcacacaggcataggtataaatcatgtggacataaaagacaggcccgtaaaccacctgccccacctcaaagcttgtataaaacagatggtggtattcattggtcagcaggaaggaatagttcagcgccccaatgccaaacagcacggccaccgccagacggcccagcctccttttgctgtaaaggaaggcaaacaccagccacgcaggcccgataaaactgattcccacataggaaatcacataggtcaggtattttatccctctggttacggacagggacgtgaacagctgtggtatacaccatattatgataaggaactggcagatggccagggcgccggtggtcttattcttatctgcttttatcagcagccatccggacgtgcagaatgacaggatgatggccgaaagatatgcaattttcagcaggatatccaacataacagaacctccccggagagcttattgctttccgtttttcctttttctttctcctgaaaacacatcaggggacagaaaaacctgtccccttgattatagcctttatgtaacaatgtgtcaaaacaatactggcgccagggtgtgtctgaatgcttatccagtgctttttcagtgctttttcagttccgtggatgccgcgaagatgataagccccagaccggctgccagaagatatacccaccaggacaggctgagccagaatcccttggtcatatacagcgctaccgtgacaatgatgatgccggaaatacggaaccatcttacacatttccttacatgcgcccacaggaagattaccaggcacaccgcttccaggatcagtgcatcgcctacatttcccgtataaaacgcgtccagtatcatggcccccaggcacaggcagcagatggctgtctgaaaccagggaatgcacgcctcgtccttccatatacgggccagggaccagctaaacaacgccgccggcgccagctgtacctccagccggataaggtcgggccactggatatacggctgtatccagaaggcaaggactgccagggcagatgcaatggtaagcgaacctttcctcaatggcttcaccgctgtatactgaagtacataaagcgctgccagaaccgtgtaggcacatctccagccccgtcctgcatcaagggccagggaaaccaggggcaggatgaccaggatatggaaccagtccacatcccatgcagccgggacattttcccgctgtctgaggattggcctgtaataccggaacaggatacccgatataaggaccgctgcccctgtaaaaccgcaggcctggttccctgtccatccgtaccttaaggctgctgccagaggaagcggcagtacggcgatggccgccgccaggtgaagccacatattccctcccctgtaaaacatgacatagaatactgcaaaggatgccagacagggaaccaggttccaggcagaaagcccgggattccaataaaatgcggccatcgtacagaggaacacggccagtccggtcccatcccagaaccatgtcccggcctggctgcggtcccggcagcacatgacggcgtattcggccccatatgcaaaggttacccacatcatgaccgccaccccgttatcggtatggctgctggcaaggatatagacgcctgccagggaatacagacagctccccttaacataccatccctgcagtttcccatcctttctaaaggaccagattaatagatatacggccaacaggatgaagaacggaaggggcttttgtccatttatctgaaaaaggatctgtgcggccgtccctattaccaggatggcctccccgaacctgtcgcgtctgagcacatcccacacagccatgatcaggatgtatgcaaatacaatcacatcatatcgcggttcaaatcccggaatctgtgccaaagcccttcccgccgtcatggtaagtgcatagaggatgaccggaatgatttcgcgcaggactggatactgtctgccccaccatgccgtgacggctgccagaagcaggaccgcggcagataccgctgcctgggttcccaggtcatgccagtacagggattcagccagaagcatcagcgtatcaatggcaaggactgctgtcaagacacagccgcccgcctggctgcaaagagggcttccctttttccgctcagccaggaaccatccgccagtcaggaccgcccctgcaaatatctgatatacggactcaaaggggaagcagagacctgcatactggaaaaatgccgccatggaaacgctgtgaaggacgcgcatctccatacgcctgtccctcagggctttcagtgatatccctgctgttgtcagccccaatgccagggtgctccatggtgttatccggacgattcccaataaagaaaaaccggttatgccagtcatccatccggttattgccgctaatgccataaggccgctgaatatccagaaatgaaggtttacaaagaaactgaatccggcttccatgaattccggaagtaaatatttatcggaaagccttgccgcggccccatcctgtcttcttctgattccctcgtcccacaaaagcagcaggaaggaatagtataccatcacgttaaggcagcccgcgtaccccaggcccaaggcccccataaggaaggtcatgctgaccgtcatcccccagaaacaggactgggtataaagcctgtcgcggaacttcctggttcctgcaagcatggcaatctccgtcaccatactgccaacccagagtacccggtaacggttctgccccttaaggatgaactccggccctatgaggccgaaatatccggcagccaggacggtcaggaaaagaaatatgcttccaaggatgtaaaatgcctggctggtcctctgaatcttaaggattttcccagccagcaggctggaaccaaagaacaggcccgagaaccccaataccatgatcactttgcagtaacttggaaggacatgccatgccgtggtggcaaatatcagccctgccagaaccacaaatacaacgccgataatcagggccgcggttccctgatagaagtgggagtccgctttgcgggtcctggcgggggaatccggccttgtgttggaagatgtggggtccatgactgccgccgctatccccgcaggcacctccgttactttcatggcagatgacacagtaccttccatagtctcttccataagcccttctatagtctcttccacaggcccttccacatacccttgcccaggcttttcctcagcctctttcacggcccgccttccatcatatcccggcaccagccattcatctgacggtatttcaggttccggtggattgggggactcaggttccggcggattgggggacccaggttccggcggattgggggactcaggttccaacagattagggggcatttccccttccatggtcctcttcctctcaaaaccgtacagcctttggcgctccagctggcaggtcagttcctgtatcctcttcttatgacgcccgttggtgacggcgagtccgattatgacaccggcttctgcaaaaggagccaccagccatattaataaaatcatgattatctccatatccattcccctttcatcagatacttcctcttcatgattttattatagataaatatcccagcacttcccagatgtctggcgtcattatcagaatgacatttgtcactgaaattcctatatcagcaccccataagcctgcccagctgccctaatatctcctcatccggcaccaggcttacatatccgcccaggcagatggatggttttgtctttccatggtagtcgcttccgcatgtaaatatcagcccgttcctcctggctgcgtcataataaaaggctgcctgctccggcgaatggtaactgctgaaggcctctatcccgaacagtcccgtttcaatgatcggctccagcaacccgctgcggccctttaagttaacgccgggatgggccagtaccgcacatcctttatttttgtggataatatcaaccacctgctctaaatccggatattccatctccacatagcagcattttccctgtgaatagtaatcccagtaaaaattcacatagggattatcggcccgctccccgcccggacggtaaggccgcagcatgggatggtctgcgtattcaggtttatccaacagtacttcggcgaacatttccccggtccatatgtccttattaaaattgttctttgccagttcctccatctcctgttccgaaacctgaaatcccatcttccttgtggcctgaagcatctgccgcgatgcaacggccccctgggcagctatattatcctctatttcagcaaaatcctggctctcatattctattccatatcccagcacgtgcaggtttaccccacggaacgtgcagtcaatttcgattgccggaatataggtgatgcctgcctttgcggcttcaagctctccccgggcattggcccgcaccgagttatggtccgctatggccatgacctttatgccgctgtcactgcatttcctcaccagttcttccggtgtaaactccccgtcatcgctgtaatagctgtgcatgtgtaaatcgattgattttcccaacatggatttttcccaccctttccgtcattatgatcatgaaaccgccaaacaccagcaggcatagcggatacagtccaatactgatacgctctcccagcaagccgaacaatggcggcatgaacgtgcttcccatatacgcgcaggccatctgcatccccatcatggactgcgagtactttgtgccgaaattatccggtgtctcatgaagcaggctgggataaataggcgcgcagccaattcctatcatgacaaggcctgccagcacagccccatccccaaaagccgccagcatcaggacagcccccgtgcatgccgccgcctgaccgcaccgcaccattttcctgtcccccatacggtctgtaacaaatccgcataccagacgccctgccgtaatccccagataaaaaagggaggcccattttgctgccgtcccagccggtatccctttgtgaaggaccatgtaactgctggcccatagacctgccgtggcctcaagggaacagtaacagaaaaatgatgccagaaccgcctttgcccccggaagcctcaatgcctctcctattcctatcttttctcctgcgtctgcgttttctgcactggaggcttttttcgatttccacagaggcagggacaggacaaggaccgccaccagcacaacctgtatgattcccactgacatatagcctgaatcccatctcagccctctggcaagacacaatcccatgatataggggcctgcggttgccccgatgccccagaagcagtgcagccagctcatatgccgtgatttatagtgcagggccacaaagttatttaacgcggcgtccacactgcctgcccctaatccatagggaattccccagatacagagctgaaggaaggtacgggaggatgaaaaaccgaacagggcagccgctgtcatggccacgctcagcgcggtaaccgccccggtccctatccttcttatcagccggtcgctcaggatactggatatgatggtaccgcctgcaataatcatactgatgattcctgcataggataccgctgcgtccaattccctgtacatggacggccaggcggaacccagcagcgcatccggaagcccaaggctgataaaagccagataaataattactaataacaactgaaacattgtgtcctcctgaatcataaccttttattgaaaaccgccgtcttcttagaaggaggctttcagtaaaaggataccgtctttctttccttgattcaattcaaatctcgacttataatataagaaaagcgaccaaacggaggtgtgaccatgggattacagaaatgtgccctcaacctgaaccgcataggcaaggagcttcagccccatgggacggcaaaattcccctgtgcaggttattctgccgtctatacggacaggccagaggatgtcatcccctggcactggcatgaagagctggaaatcgtgtatgtggaaaccggcggcttaaagcttcagattcccggaaagacctttcatgtagggcagggggagggatttgtcatcaattccaacctccctcattttgcagcagcggaaaacttctgcgacctgcattccctggtcttccatcctgttttgataaccggcaacaaggactctgtctttgcagtcagatatatgacgccgctgatccattgcagcacatttgacggttgtcccttaagcctggcggatgcatttaacagggcgttccgggcattgaaggaggagcgcacgggatatgaattcattgtcagggaaaatctgtccctgatctgcctttcccttcatgaacgctatgcccatgagattgactcgggtgaaacagggctggatccggacagcaggcgcatccagatcatgctggagttcattcatgacaactaccatgagaatctggatctgacacagattgcgcggtcagcagacatcggtgaacgggaatgtctgcgctgctttaaacgcagtatccagaattcccccatgcagtatctgttaaaatacaggaccacccagggcgcagccatgcttcttcaggatcccggcagcagtgtctccgaaatagcagccatgtgcggatttaacagttccagcaatttctcccagatgtttaaacgtttttacaaatgtacccccagggaatacaggagggatcatggcaggtaagcccctgcctgcaatgcaaaaggttccggcgtagaatcagccggaaccactgcatttcatcaggcaaagtcagttaaactccggtcatgccggatcatatctcctcagtcaaatcctcacctgaatcagggattgcgataaatcaagcaaatgccctttgtcgattgcttacttatgattcagagctgcctgggtggtggatgcctttgcagagcaatctaacctcctatatttttatatctttccactctactaaacaccatggtctaaccctatcaaatatgatatactatgtgtgttgtcgcaccctatactggcagcaggaaagggatgcttacttcatttgcgaatggctagataggagataacggcgacaattagcctaatgaaaaccccaggactggtactcctggggttttcgctttgtgcttatatatagaactactctcttttgcctgcctatattatatcaaacacagtctgcaaaatcagtccgtagtttctgtataaaccgcaatgttacttattattcagagccgcctgagctgctgccagacgtgcaatcggaacacggaacggtgagcaggatacgtagttcagtccaatcttatggcagaactctacggatgacggatctccgccgtgctcgccgcagataccgcacttaaggttcggtcttgcagcgcgtcccttctcaacagccatcttgaccagctggccaacaccttcctgatccagtcttgcaaatgggtcagactcgtaaatcttagccttgtagtaggaatctaagaacttgcccgcgtcatcacgtgagaagccgaaggtcatctgtgtcaggtcattggttccgaatgagaagaactctgcctcttcagccaccttatcagcggtcagggctgctcttggaatctcaatcatggtgccgatgtgatactggatatcggaattcttttccttcttaaccagctcagcaatctcaactacgatgtccttaacaaacttaagctctttcttctcgccgacaagaggaatcatgatttccggaacaatatcatatccgcactcttccttaacctcgatggcagcctccatgacagcccttgtctgcatcttggcaatctcaggataagtaacagccagacggcatccgcggtgacccatcattgggttgaactcatgaagctctgcacacttggcatttacttcctctaccgtcattcccatatcgtcagccagggccttgatatcctccgggtccgtaggaacgaactcatgcagaggcggatccaggtaacgcacggtcataggtctgccttccagggccttgaacatggccttgaagtcacccttctggaaaggaatcagttcatttaatgcttcttccctctgctcaactgtctcagacaggatcatcttgcggatcttaggaatcctctccgcgtcaaagaacatatgctcggtacggcaaaggccgatgccctcagcgccaagcttaacagcgttcagtgtatctgcaggagtatctgcattggtgcgcacgctcagggtcctgaactggtcagcccactccatgatacgctcgaagttgccgcttacagttgcttcctgtgtagcgatgtcgcccttgtaaatctttccggtagaaccatccagggaaatgtaatctccctcatggaatgtatgtccgccaagttcaaataccttagcttcttcattaatcttgatttcaccgcagccggatacacagcaggttcccatgccacgtgcaactactgctgcatggctggtcataccgccgcggacagtcaggataccctgtgcagcgtgcatgccttcgatatcctcaggggatgtctccagacgcaccaggatgaccctctcgcctctgccgcccttgccggcgtccttggcttcatcagcagtaaagtataccttaccggctgcagcgccaggagatgcgggaagtgcgcttccgattacttcgccggccttcaatgcttccggtacaaaagtaggatgcagtaactggtctaaggacttggcttcaatcctgcatactgcctcttcaggagtaatcattccctcgtctactaaatcgcaggcaatctggatggctgccggggcagtcctcttgccgttacgtgtctgtaagaaatacagtttgccttcctcaatggtgaactccatgtcctgcatgtcgcggaaatgattctccagcttcatggccaggttcatgaattcctcatagcactccggaaggtcttctgccagcttggagattggctgaggtgtacgtacacctgcaacaacgtcctcgccctgtgcattaatcaggtactcaccgtagatacccttctcacctgtggatgggttacgtgtaaatgcaacgcctgtgccggatgtctcgcccttgttaccgaataccatggtctggacgttaacagcagtaccccagtcgccagggatatcattcatacggcggtatacgattgcacgtgggttgtcccatgaacggaatacagccttaacagcgcccataagctgttcctttggatcctgtgggaactcctcgccgttcatggcttccttgtaaacagccttgaacttctctgccagctcttttaaatcatcggctgtcaggtctgtatcaaaatgtacgccctttgcttctttcatctcatcgataatcttctcaaaataggacttgggaacttccatgacaacgtcggaatacatctggatgaacctgcggtaggaatcataggcaaatcttggattgcctgtcttcttggcaaagccctcaactgcaacgtcatttaatcccaggttcaggatggtgtccatcatgcctggcatggatgcacgtgcgccggaacgtacggaaaccagcaacggatcttctgtatcaccgaacttcttgccgttaataccttccatccatgtaattgcctcaaaaatctgctcctggatttcatcggaaatctgcttgccgcagttatagtactcggtacaagcctctgtagtaactgtaaatccctgtggaataggcattcccaggttggtcatctctgctaagttgcagcccttgccgccaagaaggtttctcattgctgcgctgccttcatggaacttataaacccattttgccataagttaatttcctcctcatgttcttgtagactggctttctactcttatatctgccttattctttccgggcggaacaaatgcttctctcttgtccgtccacctcgtccattatatcacaaacatttcttgagtaaagagtttttccgcgaaaatttgttaaatttcaagtaaaaaacggtgtaagtactttcattttctgtcattttcacatatccgttattgattcgcatatacgaatatgcatccggggatgtacgcatttttatacatccggcctgatatgctgcctgtttttcatatccgcattcccatctgttttatgtaagcgcttacaagttttcacctgcatatcaggcactgtcctcatcaagcattgcctgcatccggcactgtccccatcaagcattgtctgcatccggcactgtccccatccgccgctttcatccgtccgtgctttaccccatgctgtttttacagttattcttatagtcaaatggattctgcccaaagttctttttgaacaccgttgaaaaatagctcaggttggaataccccacctgctccgcgacctcatataccttcaggttggttgtctccagcaggtgcagcgcatgtttcagcttcagattattcaggtataccacgaacttcacccctgtctcctccttgaacaggcggctcagatactcggagcttaggcccgcatgggcagccacgtccggcagggccagggattctgcaaaatgctcctccatatagcggaccgcgttccgtatgggcgccgaatacgcttcattcctcacaccatggatgccgcaccaatcaaatccctgttccatcacagcgtccagctcatctaaggacattgctgcagccatgtcacggttcaggcatgacagctgttcctccaccttatccacgtcatccttagttatatggtacagggaggtcaggaaaaatgaatacagcttcttcaggtattcaatgtccgtgacctcctctgagcgcgcctcggccatcatctcgtccctgatttcctctgccctggaataattctggtttacaagttccttgctgaaccggattttgtatttttccccgcctggcagacggtatcttcccgttggctgcacggaaaatatcttctcccttggatgataaaaacatagcttgacccggtcatgggcctgcctcatggcatcccccagcctgcccagatcgtcatatatgtcgctgcacccaatgtggcaggaaacctgctttaagatcagctggcaataaagatgcaggtcctccatccggcgcaatccggacgcagaaggactgcgccgcaggttcccaagaaggatggtatggttcagctccagaggcacttttatcatatgctccagcgggccgtcaccaggcagatcaatccgcagcggcccttcctcctccgtcatgatatccagcgcagcgaactccctcttttccagcgtgacatcatattcctgcagcatggaaccgcttacctggaccgcgtgtgtgcttaagaccagcgagcgcagataatggttccggttggagatctcctcataatgctttttcagcccgccgcccggctctcccacgaccgccttccttccattttccagcgcctgacgcaggctctcctccgtaatctctgtttttaatatgtattcagaagcacccagcttgattgcctgtctggcgtacccgaaatcctcatggctggtgagcactgccacataaacagccgggttgatgctccgtatcagcttaagcatttccataccatccataacaggcatccgtatgtccgtaataatgatatccggcacagtcttcctgaatatggaatatccttccgccccattggcagccgcacccacaacctggtatccttccatcttgttaatgcagaattccagccactgccggattggcacttcgtcatccgcaaccagtacctttatcatggcatctcctttacatatcttaatcaattgccgggaggttcaggatgattttcgtaccctcccactggacactttctatcttcattccatagttcccgccaaaattcagctggatccgttccttgacattcacaatgcccacatgggccttttcacccatccgttcccccctgttgatcttctcaatggtttcgggagcaatccccatgccgttgtcctccaccgtcacagcgacgccgccgtccaaggccctggccgtgatgatgatcagcccttccccttttttgaattccaccccgtggaagatggcattttccaagaggggctggatgagaagcttgggtatctttttttcctccaccccttcatcacattcaaatattacctggaaaccgtcatcatatcggaatttctggatttccacatactggcgcagcacctggaattcctcccgtatcatcacgaactcattggggttggacagggtgctgcgcagaagctggataaaggaaaccagcatcctggacgcctcctcattcttttccatgtccaccatgcacttgatggaaaacagggtattatacatgaaatgcgggttgatctgggcctggaggaaactcagctccatcctccgcttctgcttctccttctgcctgattccctccatcagacccctcatcctgttgagcatggcattgagccggttgctcaatatgttaatctccgtatacccgtggacgctgcattcctgatccaggttctcaccttccacctgcagcatgaactcacacagctgggagatggggcgggtggtcttatccacaaaatggcatgcataaacccccgccgcccccacggccagaagggccatggtcaggattaccagccgcacctggcggataggctccatcagcacggacagcggtatctcctccaggaccgtgaacccggaagcctggtcataataatgggtaaaaagaatattctccccctgcatccttgtaaatatatagggcgcaccgccaaacagacgttccaggttcttcatatggaagaactcaaatccattgagcttgcggttgcttgaggatatgatggttcctccctcatccaccacatataccgtattccggttcccctctgtcagcgactggtacatgccgtaaatctgggactcctccatgttaatcatcaggtaggccaggggattgccttccttgtcattgatggagcgggccacacaaaagtaatcggtctggttctccttatccttaaagcatgcgatatcaatcatatccccatacgcaaaaagcattttcttataccagatctttgtcttgggactcatgtaactgcagtccacgtgttccggggtatgcaccatacagtatcccccgccatgttccagggccagggtcacctggaactgccgtccgctctcataaaaagaattctggtactgggaggtcagccgttccatgtacgcctcaaactccggcgccagttcctcctgttcccctgcatccatcctctccagatagccgtacagggtgctgtcataataataaaggttggaaagggtataggcgttctcctttacctggcggacacgctcccctacctggcgcagtacatcggcccggttgtgtccaatctccgaaaccagggtccgttcaaatgttttataaccaatggccgacacgatgatggtcaggatgaacaccgctgcaaacaaagtgaaaagcagacgtattttcatgctgttcttatccacccgccaggaccagatgctgcttttcacggctcacatatcccctttctgattttctgatcagcttttagtatagcatatataaaaatgcaaaaacaaccccagcgcctttttccgggaacagtccgcggacaaaggcgccggaggtaatccgtcagtattttccaatccgcaggggaagcgggtcttctgtttcaatgatgcggtccatgagttttttcatcatataagcctttacagccccataagcctcatcatcccacagattcttaaactcttccgggtccaggttccggtcataaagctccccgtattcctcccccgcataataggtcagcttgtaattgcgtccggtcagggtcttcacgctaagcccccagtcataacagttaaattccgtcatggcatattccttacctgcccccttgtcccccctcaggatgggcgccatggaacagccctggacaccgtagggaggccgcacccctgcgtactccaaaagggtgggcatgatgtccacatgttccgtgacctggctgtagcgggatccctgtggaaccacccccgtccacttgatgatcataggcgctttgatgatacagtcatagtggaacggccccttaaacagcagtccgtggtcccccaaaagctccccatggtcattggtgaacaggatcagggtatccttttccaggccattctccctgagcgcatcaaggatccttccgatgttgtcgtcaatcagggttatcatgccatagtaagccgcctttatctgaccccactgatggtctgtcagcttccggtagtcatatttttcattggaaaatccccttgcggtcaaagccttcctgaaatggggcggtttgtcaagaagctccccttccatccgtaccggaacctcaagggcatccgggtcatacatatccccgtaaggctttggagggtcaaagggatgatggggatccacaaaggaacaataggcgaaaaacggctggtccggcccggattcctcaatcaggtcaatcatccggtccgcaatccagtgggactgatgataggatggattgatgccgctgggataaacctggggcggcccgccggtatccttatccgcagccgacgccctgtcctcttttgccttgcgctccccttgcattttcacttcctcataatcctcaggacttgccgccttcagccagtccaggtattcgcctgtcttacagtcacaggtcgtgtggatgatatcaaacccgtaattatcctcaggccagtcctcctgttcatcctccttgggcacaaactgggttgtgatatgcatcttcccgatggccgccgtgcggtagccgttgtccctcagtgtctcagccagggtaatctccgaatccctcagggggatgccgttgtccctggtcccgtggtttttcggatacctgcccgtgagcaccgtgcatctggagggggagcacaccgggttctggacaaaatgattatcaaatgtgctgccgttcagtgcaaggctgtcaatatggggcgtatgtatctggttgttcccatagcagcccagggcatcaaaacgcagctggtcacacataaacaggatgatattgggccgtctgtccgccatttccctttccctcctttaccaccatttaattaattccgtcacatgattgcgtatttccacaaaatccctgtccgtcacatcccggggccatggcagggtattggcaatctcttttttgattttggtcggcttattggtcagcacaaggatccgctggcttaaatagaccgcctcttctatattgtgggtgatgaagatgaccgtggtccctgtttcccgccaaaggcgtatcagttcatcctccaggcggaaccgcagggaaatgtccagctgcccgtaaggctcatccatgatcagcagctcgggctgcactgcaaacgcccttgcaatcaccacccgctgcagcatgctggctgacagctggtccgggtaatagccgcggaattcctccagcccgaccatggctatcacctcatcggcccgcctctgcacctcatcctcaggcagccccttgatgcgaaggccgtattttacattttcctccaccttaagccagggaaatgtggaatactcctggaaaatatatgcgatgttgtgcctcttcagatccacaggctccccgttcaccaggatttcacctgccgtgatatcgtacagtttggtcaggctgtttaagaatgtggtcttgccgcagcccgtcggccccacgatacagaggaactccccttcctttacctcaaaggaaatgtcgtccagcaccagaaggtccccgaattttttcgtcaggttcttcaccttgacctttaccttatcctcactcatgacgcgctcccttctacaatgtctcgtccgtattatccagtatttcctttctcaagcgcaggaattccgggtccacatagcttctgggcctgggcaggtccaccgcatattccttcttaatggtagtaggacagttggtcagcaggatgatccggtcagccagatagaccgcctcctcgatgttgttggtaacaaagacaaccgtgcgtttttccttctgccagattttttccagttcctcctccatcatatagcgcgtctgggcatccagatgtccgaaaggctcatccatgagcatgaccttgggatcgttacagtaagccctggcaatccccacacgctggcgcatcccccctgagagctggtttggaaaactattttcaaagccctgaagtcctaccaggtcaatgaaatactgagcccgctcccgcctggtcttcttgtcaatcccccgcgattttggaccgaactccacattgcccatgacggtgcagaaggggaacagcgccgtggtctgatataccacgccacggtccgcgccaggcccttccacctttttaccgtccacggtcaccgtgccctccgtcaccagctccaggccggcaatcaggttaatcatggtggtcttgccgcactgtcccggcccgaacagcaccacgaattcattttccttcacttccaggcttacattatccactacttccttcacgcgccccgcagattcaaaccgcttcgtcacgcggtccaggctgattacactatgtcctagacgtccattctgttccatgaacaaagcctcctttccgccgcccgcataagggtggccagtaccaggcccaccaccccgatcacaaccattcccacaaggaccaggggaatgttgatggtatcgctgcccctgaggatgatccagccgcagccttcctgggcgcccaccatctccgctgccagaaccgccatccacgcagtggacagcgccacctgcatgcctgcgaatatctggggaaggctggagggaaggatgaccctcaggaaaatatccctgtcgctggttcccagcatcctggcacagccgatcagggtggggtccacgcgctgggccccggtatatgcatttagggtaatgttcgtaaaggaaccgataaagatgatggcgtatttgggcagttcaccgaccccgaaccacaggatgaccaggggaatccaggcaatggggggtatgggacgtatcaactcaaacaatggcttgatgattgcttccgcataacgggaggttcccatggataaacccaccacaatgccgcttaccgctgccaccgtatatcccaccagcacccgcctcaggctgtaatacagatgcccgtagatggtataacggccaatcggctcaaaaaaggacgtgaacagcaggcggatgacctgaaccggaccaggggtcgtctcccctgcagcggtaaaggtagtgatgaaagcccaggccaggaaaaaggaggcgattgccagggcggcgtaaaccgatttttccgctttttcagaaacactcattttcctcatgacttcttccctcccttcaccatgtggtcctccattttcgtcagtaccacggcaaagatggtgccgataaagccgatggtcagcatgcccacgataatcaggtcggcccttgcaagggaacggttcagctgtatcatatagcccagtcccttgttggctgccagcatctcagccgcgcacagggtggtccaggcagcctgcagggatatcctgagcccggtgaagatcaggggcatggcagttgggattgccacggtaaacagcatcttggtacgggatgcgccaaaggtctgggccacccacagatgcaccggcttggtctgcttgattccggcataagagttaataacacacgggatgaatgcagacacaaagataatggcggcctttgcccccaggccaatgccaaaccataggatcatcagtggaatccaggcaatggtgggcaccgggcgcaccaggtcaaacagaggcgtaacgaataaatcaatccgcttgaaccatgccatgcagatacccagcgggatcccaatcaccgcgcccagcacatacccgctcagcgccaccttaaggctggccaggatatgctggaacagggtgccgctgtccggcgccttgtggttcaatttatatataaatgcttccagcacctgtacaggacttggaaggctgtaatccggcatcagatgcaggacagcagtcgccagataccagatcccgaaaaacatcaccagggaacatacggagattgcggcaaacttacgtctgtcatgcagctgtttcttctctaattctgtcacgtctaacccacctttcaataattgagggcgctgtttcaagcgcccttatgatccgtatggtcttataatcagtaacccagagcttccttaacaatggtatcgtccacatgttttgcaatatccgggaacctggattcctccagcagttcctgggatacccagaattctcctgttatctggacagaatcgccgattgttatggtctttgcctcctcagaggtcacaaatggacgtgtctcaatttctgttttacaggcttccagggaagattccgacccattctccgtgtaccagtcaagaagcagctgggccgccatgtccgggtcggcctgcagtgcgtcggtggcctcaaaaaatgctttcacataattcacaagcacatccctcttgtccgtaaatgccttattgctgacaatgatggaatcaaactggggcactcccaggttggtcaggctggaggtaatgaccatcccctcaccctctgcctgataggaagtgggcggattcagggcagccacatcgcaattgcctgtcatgagagcctggtatgcggacgggaaatccatatgtacaatctccacatcctcagtggtaagtcccagcttctcaagccatttaatcacgttcagatgggaaatggttcctgtattggtggcaatgaccgcgcctttaagtgtttcggcatcaccgtatacatccgggtaggatgggttattgcccttaacctttgcaatgggtgaatccggcttgcacagtgtataaagcccgccctctgaatggccgatatcagcaatacagtatgccccgtagatggccagggaattgaccgcggccgcgctcagggtccccacctcccactggtcggctgccagggcctcgttcatggccccgccgttggcaaagtaaactgtctcaatcttaaaaccattcttggtatccagcccctggtctatcatatacttaatcgggatactgtttaagaagggcatgaccgccaccttcagcacaggcaggtcctccgtatccggagcagcctgggttccggcctccgttgtatccccggaagcctccgtggccttggttggggccggtgttgcctccacgggttttggcgcacatcctgccagtgtgcctgccagcattgcagccgccattactatgcttatccatcttttcttcattacgcataacctccctttcatacgcagacatgaacctgcatgctgcatgttgtcatgtttcatttgatgggataatcatactaaattcctggaaaaccgtatatctgttttcttatggtttttttgaaatttttgtcctgttggattttttatgtgaggatgttttgaatttttgatattattttagattttttagactggtttcagtatggaacggaatcaggtgttttgcataattgaaatcccgtgtactggcatacacgggatttcgctttgtgaccacatggacacatataacttcctagataaaattatttcacatcaaaattcatgtaatgtcaacatcacaccttaaaccggtacccaaccccccagatagtctcaatatattggggcttggccgtgttaaattcaatcttctcccgtatcttcttgatatgcaccgttacagtagcaatatcaccaatggattccatatcccagatcttactgaacagttcttccttggtaaacacatggttcggattctgggccaggaaggtgagcaggtcaaattccttggtggtaaatgtcttctcctccccattaatccatacgcggcgtgcagtcttatcaatcttcagtccgcggatctcgatgatttcattggaaggctggccgctgccaatcagccgctcatatcgggccatgtgggcctttaccctggccaccatctcgctggggctgaatggtttggtgatgtaatcgtccgccccaagccctaagccgcggattttatcgatatcctcttttttagccgaaaccatgatgatgggggtgttcttaacctcccttactttcttgcagatttcaaatccatctgttccgggaagcatcaggtccaggatcagcaggtcatagtcttcctttaaagccttatcaaggccctctgtcccgtcattctcaatctctacttcaaaaccggacagttccagataatccttctccagctctgctatgctctcctcatcttccactatcagtatcttgctcatcctgtataacctcctgatattttcttaggacaaagtggatttccgttccaatcccttccttgctggtagcccatatacggcctccgtggtcctctatgatcttgcgcacgatggacagtccgataccgcttccgccctgggatgaattccgggaagaatccgtgcggtaaaaccggtcaaatatattaggaaggtcttttgccgcaatgcccttcccgttgtcctcaatctccacctggatgaaatcacccacatcctttatccggatattgataataccctttttcttatccaggtatttgaccgaattgctgatgatgttgttgatgacccgcttcatctgttccgcgtcagcaatcaccacgatatcctcatccacgtaattgaagtagcccagttcaatccccctggcctccatatccactcccacttcctcgacgcagtccctgaaatactgggccacattgattttggtaaatgcatatggaatcttgttggtatcaatcttggaataaaaggtaagctcatcaatcagtctgtccatgtcattagccttattgtaaatggtacggatatatttgtccagtctttccggtgaagaggcaacgccgtccatgattccctccacgtaacccttgatggccgttatgggtgtcttcaggtcatgggatatgttgctgatcagctccttattctccttatcatcctgtatcttctcatccgcattctcccggagcctgatgcgcatctcttcaaaatcctggcacagctgccctatctcatcgtccgcatccacatccagggtaaagtccaggttgccgtcccgtatcttcttggtggcctcctgcagtttgttaagcgggcttaagatagaacggtaaacccagagtgtaagggcgatacccgctatcatcagtatcatggcccccagtatcagcatctcgcggagcattgactttacttccggaaccaggtcgtccacgttggaaatgatgaatgcggtgccggcttccccatccggaaacgtaaaatccatctgcttaatcaggtgctggctttcgccgtccagatagataccgccttccaaatcgcccttcatggcgccaaaatgagggagctgggcacaaagcgcctcatcctccttgatattatcatccccacaatagatgattgcatcccctttcaggaccatcaggaatgcatagtggcttttcagttccgcattaatggaatccaggtagtccttatcgctgtacttccctggattcttatccagtgacttgcggatatcctcctgggaacgctttgtaagccggttgaatatctgcatggaattgccggagaagaaatccaccggctccgtcagctcatattccttgataaaggatttggcctgataattgctaagcaccatggccatcagacaaaacagcatcatgggtacaatggtaatagtcagaaatgctactgcaagacgggtctttaatttcataagtcccatcctccttcattaacttgcggtatgacgctgtacatagaaagacatactgtcacccgctattgacagtatatcacaattacttataatcgtttataaaactattataaattttattaataactctcccgtttatccttgtttcctcggcaatttctgatataataatactattgcccatgaacagacgggcgaaaaagcagtaacgattggggttaaaatatgattggtttttacagttacactgtgattttgacataccttgggctggcatccgctgccctgggcatgatgcttacatttaacggttttgccagatatgccttgttctgcctggcattctcaggactgtgcgacatgttcgacggcaaagtggcccggacaaaggcagaccgcactgaggatgagaagcgttttggcattcagattgactccctgtgtgatgttgtctgttttggcgcatttcccatgatcttgtgctattccatgggaatgagggggattgccggaatctgcatcctggtcttttatctgacggcaggtgtcatccgccttgcatttttcaatgtgatggaggaacggcgccaggatgagacggacgaggcccgcaagtactaccaggggcttccgattacgtccatttccattatcctgcccttattctgcaccctgcgtcccttgcttgggcaccgtttcctgtctgagctgcacatctgcatcctcacggtgggactgctgttcatcatcaacttccagcttaaaaagccaggctggaaaatgctcacattcctgatatccatcgtggcactggcactgattaagatatactttttttaaggaaagaaaggtgtgattgaatgaaatacgctgacagaaccggacgcatccatggcagcgacacattacaggacagatatctgcgtcttctctacggcagtctccccgggcgtttgcttttaaagccgctggtccatccagccatatccagaatcgggggccgtctgctggactctcccctgtcatccgccctgattgggccattcatacgttcctgcggtatttccgtaaggggatgtgagattccgcccggaggctcctaccgttccttcaatgcttttttcacacgttccctgaaggaaggcgccaggccctttgatatggatccggatgtgctctgcagcccctgcgacgggctggtaagcgcatataccatcagccggagccggcatttttccatcaagcacacggactataccctggaccagctgctaaaggaccgcaagctggcttcccgctacacaggcggcaccgccctggtgttccgtcttaccgtgtcagactatcaccgctatgcttatattgacgacggaaagcgctcatcctaccgcaggattcccggcgtactccacacagtgaatccttccgctgccgccagccgccccatctataaggaaaatacacgtgaatacaccctgattaagtcccaaaacttcggcaccgtgctgatgatggaggtgggcgccatgatggtcggcaaaatcatgaaccaccataaggcctacaccagcctggatgttttccgcggacaggagaagggatactttgccttcggcggctccactgtcatcctgctgtttgaaccaggcgcaatccgtaccgacagcgatatactgaggaatacggcgcttgacatagagacaaaagtgcggatgggggaacctgtgggcaggcgctcctgattcccctcctacctgtcatatgcaggcagtcccgatggatacacaacccttaccgtcttctcctcctggccgtaatccgtcagggattccctgtaagtccccatatctgaatcaatcagcgtcattttcccggggcacatccggaaggtctgatacctgctgtcatacccgttttcatcctcatggtcccggcgcaggttgaggtggatcagtccattgacccggaacagtatcccgtccacctggaacccatctgtctccgtttcccccagaacctcctttgccccctggcaggcaaggaattcatccactgtaacctgtatggcgccatactccgtaaaatccccattctcataaaagaaataatacggcttgtagctgtgaccgcttacaaacggctcactgcgtccgtcccccatctccatatatgacaccgaaccgtcatatgcgcttctaagcaggcacacattgcccatctcatccatatggaaccccattcccagaccggatagattcatgggacgcggcgagccgtcccttacggtccagagataggatgtggatgaggtaaatgcgtccagatccgtcagactgatgactttaatatcctcaaatcgataatatccactgacatactggcctcttgtttcccgtttcacttcttccatggattcctccgtgacaaacaccagcgcccccatatatccttcaaagacacgggatgctgtttcctttccgtctgccacaaaggcaaatgcctcatatgcgccatcgccatcataatcgtcataatccagggtcaggatggtcccgtccggatatgcgccctgaatccttttaacccagttttgcggacaggaaacagcacccgcgttttccacaggtggacgtccgcttacatccaccacatgcttcacaggttcccagtcatcccaggccaggtttgtaccgcttagcgtaaggtaggtgtgcgtaccaaggccggacaagggggtaatatccctgaccggattacagtccaggcatagaaggctcagcttcctaaggtccgcgagaggtgacaggtcctcaatatcattggactgcaggcgaagttcttccaatttatgcaaaccaaaaaggggggagatatctttaatctgattgccaatcaggcagaggtcccgcagattcccaagccctgacaaggcgcttatgtccgtcaggccctcatagcttacattcagtacttccagccgggtcagggttttcagcggttccaggtcatccggggaaaacgagtgaaaagccagcctcaggtccctcagtccggtgagccgggaaagttttgcataatctgttccattgcatatggttatgctggcggttgacgctgaaccggatattgtctgtatcttcccatcccagtccgtgaatgtcacatattcggatggttccagcgctcctggttgggcagacggcatactggccgtgtcaccggactggccggcggcggtattatcggtatgtccatcaccagcagcatcaacacgtccatcatcagtaacatccgtatgcccaatggccgcctggctgcttgaaacgtctgatatcgggctacacgctgaaagcagtaaggaacacaggaggacagccaggaaacagcctccataggcgcccctcatgtgcaggtgtccagcagatgatgcttcttcacataatccttccacatacgtgcctccggcatctaaccctcccccgcacaaaccgtctgcagttaatccctcttcacataatccgccttcgcacaagccgccctccaacaccacatcccatcctctgccgctctccatctccgcctcctcaacaaacctccataatacagggaaagccgcacatccaggccagtccttaaggtgtgcagctctccgttattatcccatcttatgattatgcaaaatgcagccatacaaattacagctctatcgaatgtaaatactcaatttcccctaaaacatgaacttatcagcgaagtaatccttcagttcgctaatcggaatccttacctgctccatggtatccctgtcgcgtaccgtcaccgcgtggtcttcctcggagtcaaagtcataggtgatacagaacggggtgccgatttcatcctgtctcctgtatctcttaccgatattgcccctgtcgtcaaactcacagttaaagtacttggaaagctcggtgtaaaccttctcggccccctcgttcagtttcttggacagcggaagcacgcctaccttcacaggcgccagggccggatggaaatgaagcacggtcctaacatccccctcgccaatctcttcctcgtcatatgcagcgcagaggaatgccagggtcacacggtcagcgcccagggacggctcgattacatacgggatgtacttttcctttgcctcgtcatcaaagtaggacatatcctgtcctgatacgttctggtgctgtgtcaggtcataatccgtcctgtcggcgattccccacagttcgccccagccgaatgggaacaggaactccaggtccgtggttgccttgctgtagaaggacagttcttcctgctcatggtctcttgcacgcatctcgtcttccttgattccaagggcttttaaccagtcgatgcaatactgcttccaatatgcgaaccactccagatccgtatcaggcttgcagaagaattccagctccatctgctcaaattcccttgtacggaaggtaaagttacctggcgtgatttcgttacggaatgacttgccgatctgtgcaatgccaaagggaaccttctttctggaagtcctctgtacattcttaaagttgacaaaaatgccctgtgctgtctccggacggagataaaccgtgttcttggcatcctcggtaacgccctggaaggtcttgaacatcaggttgaactggcggatttccgtaaaatcatgggcgccgcagcttggacagcagatattgttgtcgtcaatgtactgcttcatctgctcctgggaccatgcgtccacggagccttctatcttaataccgtgttcatcgttaaaatcctcaatcagcttatctgcacggaacctctccttacactgtttgcagtccatcaggggatcagagaaaccgcccagatgtccgctggccacccaggtctggggattcatcaggattgcgcagtcaacacccacattgtatgggctttccattacgaacttctgccaccatgccttctttacattgttcttcagctctacgccaaggttgccgtagtcccaggtattggcaaggccgccgtaaatctcagagccgggataaacaaatcccctgttcttggcaagcgccacaatcttttccattgtcttttccatatccgtatcctctcttttatcttcattcattctatattaatctaagatgatatagctggtgccttcctccggcgtctcaaccgtgttggaatccctcaggctgcacccgtcactgacataaaggattttcttttccgtcttgatgacaccagggccttctgcctttaccagcacctgctggccgtccgacactgcctgggatgcatccaccgcattgcccttgacatccttaaatgccacgtcctccaggccctggcccagaaccgctacccttcctgcctccagcgctgtgaaggtcacattataatccccgatttccctggcaaactctatgatgcgtgaagccgtatcatattcagttacggtaaatgccttaccatccccaattttggccgatacaagggctacaggcagcttctcagcgccctcggtgttctcggactttgccgccttgccaagggaactgttgaaatcgctgatgcgctgttgcacaaatgccttcagctcctcctccgtataatcccccttgtcataggtttccacggatgcccactggacattgccgtccttttctatcatcacgctgttctccacaggcgtccccttgcccggtgcgccgattccggcacagcccgtggccaggaccgcggccgtcatgagggccagcgccattgccatgatttttttcatactcaatcctttcgtgtgattaatccgcagacccgccggcagaaaccagtacccattggcgtccgtcatgggcctacccggatattatatcctctacatcctataatttcaagccttagaatgtattttatccggtgagctcatccaaaatctcaagggatttgaactcatggcgcacataatagcgcctgctggcctccaccactgattcaaactccctcatcacatcatcctttaagatgaatttataaagggattccacctgggaacacaccacatattcccaggcatagctgcaggattccgaaaccggccttggcggttcctccgtatactccccgttaatgaccatggatttaagctcaaacacccgccttgccagacggttagggatggatgggttcaaaagggcgcgaagggactggtaaagcagctttaaaagttcggtgccgtccatattttcctgtgaaaaataatccgccacctccaaaaaataggagccgtagcacgtgcactccatatccagtgacagcccgtcaaaataattggcaatctgcgacgactgaaggttataggcgctcctcccctcatacagggtgaaggtcccaaaggaaaaaggcctgctggatgccatcaggggatttcctggttttctggcgccatgggcaaacgcggtaatacgtccccgctcccttgtgagcagcaccagcctcctgtcataatccccggaaggagctgaaatgaggaccatcccggtcagtgttactgtctctctcatttcagaatcccctcccctctgctatccatcagaccttatcttcgttttatcttgtggcattcgccatatatccgttgtaaatacaacgttttttacacatccttgccatcgtaaccatagttcttcatataaagttcgctgtcccgccattccttcctgaccttgacccacagctttaagttcacctggatttccatcatgcgctcgatgtccttcctggcttccgtaccaatccgctttaacatgctcccgcccttgccgatgatgatgcctttgtgggaatccctctcacacacaatgctggcgtcaatgtccatgatgccgtccgggcgctccttcatcctctcaatggtcaccgcaatcccgtggggaatctcatcgttcagaaggcgcagcgccttttcccggatcaactcagccgcaatctggcgcatgggctggtcggtcaccgtatcctcgtcataaaactggggaccatagggaagatacttgaaaatcagttcggtaagcaggtccgtgttcttctccttcagggctgacaggggtactatctcggcaaaatcacatatgtccttgtatgccgccatgaaggtaaggatttcatcctggttcttaaccgtatcaatcttattgatgaccaggatgatcggtgtcttcaccttattcagctgctccgcgatatggcgttcccctgccccgataaaggtgcttggttccaccagccacaggatgacatccacatcccgcagcgtgtgttccgccacattgaccatatattcgcccagcttgttcttggctttgtggatacctggtgtgtccaggaatatgatctgtcccctgtcatccgtgtaaacggtctgtatccggttcctggtggtctggggcttgtcggacgtaattgcaatcttctgtccgatcagatggttcatcagggtggatttccccacattgggccgcccaatcagtgtcacaaagccggatttcttctgtgtattctcttccattcatatctccttatcagtggtacaaattcttgatttccccaaacattgcccggtccgccttaatctgttcatcattgccgatcacgcacagcgcccctgtatccagcacggcctgcacgatgtctgccaggttccttatatcctcctgggtcacgtccaggatttcctccctctcccgctgtatcatctcatcggtcacgccggagagataggcggaaaggttcctgctgcccttcagggacggggtaaggggtgtgtccacatcactgatggtgccgattacatatttggtcatatcccgctcatcgatggtgaagcttctcagataatccggtatgccttcgtatatctcattggttttcgccatgttcgggtcgcggtaggataccatgtacccttcccccgacctgccaaagctgctcatacatccatatgcgccaccttttacgcgcaggttcatccagagatactcatagttcatgatgaccttcaacaccctcagcgccccggtatactccaggctgcgtccattgacactcttatccgcaaaagaaccgcaccttgccacataattgacctgggaagctgttttatatccttcattgcggttgccggcttcaaaggtaaatgcgtgctttttcccgctgccttccaaaaggcctgccttaaatgtctgaagctccacaggaaggcgtccatagccctcctcatccgccgtatacgccacaaggatattatcctttgtaaacagctgccgagccgtgctcttcagctttcctatcaattccttcctgtactgcggctcctcactgtacctgcggcttacatactccaaaaactgataatatccgattccgcctatgatatcgttgaatgccgaggttgccgagtagtaggaggacgccctgcccaccgcggccgcatgggaggaatcctccatcttcatcctggccctggaacgtgtctcgtccaggatttcccccaaacgcttctcattatccagattggaacgcgtaaggatttcggtcaggatggaaaatgcaaaatccagtttttcatacagtacctttgcgctggcaacaaaggctccggtaaaccggcccggattagccatatccggatatgaacttactgcaaagttcacccctccgctgtttaaatatatctcgctggacaaatcactgtagctgtagtgctccgtatccacatatcccaggacggacttgaggaggcccacataggaaaaatcttccaccggcacacggtccgtatcaaaaagcaccttcagatagccgatgccggaagtaaacatactgctgtggattacccttaccccatcctccatcttaagctcataggagagctttgcgccctcccggtcaatatcctcccgtgtgagcatggggattttctccaggtcttcctgggaggaggtttcctcctggtatgccttcagcgctttggtccgggccacaagttcttctatctcttccctgccaagggaggctttatgggctgccagcctctctgccagcttcctgtcctcctcggctgtctggtttatcctggggcttaccatgatgacagcctcatgtgggttatccaacaggtatttgaggatcagctgctcaaaatacccttcccctgccgccttcttaaggaagtcaaaggtcttctggtattccaggtgcagcatggggtccccgtcatagagccagctgtccatggaccacaggccgtacataagtcctttgggggcggaaccatagtccgcttccctgtaacggaactcatagtaattcagtccggctaaaaggctcctcttatcaatcccctggtcggcaagcctgcgcagggtgcccttgacaaccgccaggaattcccccttctgctccgggttggcattcttggctatgacggaaaagtagggctggaggatcccgctgtcatacccgcccaggatatcctgtccgattcccgcatcaatcaatgcctgcttaaggggcgcgcccggagcattgatcagggtatattccagtatctggaaagccacatacagttccggatccaaatccgtgccaaccaccgtgttcacggacagataggtcctgtcggccgtcccctcctcctctgtgacggaataggtaatctcccgttccaccggaccgtcaaatgccttctgcatgggaatggaggagtccgcatgacagtccttcctgtcatacctgcccagatattcctcatccagccatgtaagcttctgcgccatgtccatgtccccgtacagatagatatagctgttggccggatgatagtagttcctgtggaattcaatgaactgcccataggtcaggttggggattacagccgggtccccgccagactcattggcatagatggtgtccgggaacagcacgttcctggtgaaccggtccagcacgctctcaggagaggaaaatgcgcccttcatctcattatacacaacgccgttaatggtcaggtcatcctcaggggactgcatctcatagtgccagccctcctgcaggaaaatcttgggttccctgtagatggcagggtgcagcaccccgtccaggtacacgtccatcaggttctggaaatccttttcattgcagctggccaccggatacacggtcttatccggataggtcatggcgtttaagaacgtattcagagatcctttcaccagctccacgaacgggtccttgaccgggaacttctcagatccctccagcacactgtgttccagaatatgcggaagtccggtgctgtcctcaggaggcgtgcggaagccgatacagaacaccttgttatcgtcatcattcgacataaggaacagccttgcaccgctcttaatatgttccagcaccattgcgctggaatccatttcctccacaaacttctccccggccacacggtaggcggccagccctttgactgcttccagtttcctttcatctgccatagattcactctctccatttctatatcatactacttcatagtctgccttggttgtcccagcttattcacatcctacatatttcccatgagcctgtctttgacaatggacgcacactccctgacacaaagatggataaacagcacagggtccgagtcagctgaaattccatagacattttcaatcccccacttttcagcggtcagcctggccctgtatatatggaaattgctggtaaggacaccgatttccagcggtttatccggcgcaatggcatagggtaccgaggtggtcctgcgggtcaggggaaccagttccttcttatcccggttccggtgttcctcaatcacgaccttgctgtaagcaatattctccaccgtgctcaccgaacggtcctctatgagaagctgttccggccttaccccgttgtattccagatactggcgcatcacttccgcctcgctgacatcctcacctggaccgcgtcccccggaaagcaccagaatggtgtcaggattctcctccgcgtattcaatcgccttatccagccgtttttttaatgaattactcaccgtgtgttcctttaccctcgcacccagcacaatcacgtaatccaggtttttcttatccgatgaagcagcgcccaggaacacgagcacgcagagcacggccagcgccacaacccctgccacgcaggtggtgacaacggataccgggacccatcttggaatccggtccatgttcctgctgtaataccagcgtccataaacaagaaacagcagcagggcagcaaaaaacagccagataaaggcaaaggacgtaccgataccagcatacaccactatcactataaaataggcaacgcacagcactccaagcccaataagtattccgtctaccatccccaggcacctcctgtcagcagatactttcatgtatgtccggtcagttttcctcttttttgcgtaaaatgtcgtaaaccgccaggtctgcctccggccccaaatcaatccagaggacctgcttgggatgaggcgcgctttcctgtgcatttccgtcctcatccgttatggcagccacctggaccatgagattgcggccatccggcttcatgatttccatggtttcgcccacagagaatttgttcttctgttcaatcctgcaccttccccggccgtccacctgttccacggtgccaagataggtatagttcttcacatatgtgttattgtcgtatatctgtgcatcctcagtgggtttgccaaaatagaagccggttgtaaactcccggtaggtgcatttgcctatctcctgtctgtaccactccatgttggcttcgtagagggccggatccttattgtaatcgtcaatggccttccggtaagtccgggccaccgtggcaacgtacagggcggtcttcatcctgccctctatcttgaagctgtcgatacccgcgtccatcatctccgggatatgtccgatcatgcacaggtccttggaattgaatatgaaggtcccccgttcattttcataaacaggcatatactcccccggccttgtctcctccacaatggaatacttccagcggcacggatgggtgcaggcgccctggttggcatcccttcccacaaagtaattgcttaacaggcatctccctgaataggaaatgcacatggcgccgtgtatgaagctctcaatctccatgtcctccgggatccgggaccgtatctctttgatttccgccagggaaagctccctggcagtcaccacccgtctggccccaagctggtgccagaacagatacgtcccgtagtttgtattgttggcctgggtgctgatgtggatttccatgttgggaagcaccctctttgcaatggcaaacacgcctggatcggagatgatcagggcgtccgggccgacttcctttaattcttcaaaataagcctccacccccggcaggtccacgttatgggccaggatattggccgtgacatagactttaaccccgcgcgtatgggcaaaggcaattccttccttcatctcttctttggaaaaattatgggccttggcccgaaggccgaaggcctcacctccaatatatacggcatccgccccataaatgacagctgtcttaagcacatccaggcttcccgccggtatcaacaattcggtctttctcattttcttctctccacagaactaaaactattttatcctggtgctgattgtcacgccatccccaatgggaatcaccgcggtctccagttcctccatgtgtttcagggtatggaggtattcccgcatcctgctgtggatggtcctgttcctgcgctggacggcaaacctggattccacgatatcgccgtcctggagcacattgtccgatatcaggaccgcccccacaggcatgaccttcagtaacaggggcagccagtgcaggtactgccccttggcggcatccatgaacaccaggtcaaagctcctgccttccagttccttaagaagctcatccgcatccccttccagcagggtaatcctgctttcttcacccgccttcttaaaattcccgcgggccacggggattctcttcccatacttttcaatggtcgttatatggcattcctggggcatggcctggcacatgagaagcgccgagtacccaaccgccgtgccgatttccagtatctgggccggcttaagggccgccaccatggtgcgcagcagggacgccgtctccctttttatgatggggacataggcctttagcgcctcttcctctattgtgtctaaaagcactccctggctggattccagggaatgcagataatcccttatcctgtcgttcacaatcatggatcctgtccctcagtcacgtcctcaaaccatccgccttccatctcctggtcctcgccctcataggtctcctggttggctatctcatcgctgttttcagcctccggatccatggaacggccggcagcttcctggcttcccgtatcttctgcagcccctgtctggctggcggcagccggaacaccggcttccccttccgggacagtctccccagccgtctcagcggtcttagccgcaggcgcggcggcagccttgccagctcctgactgggccggctttacatcctcctcagtctccggcttttcgttgagctgctggaggatttccttggaggtcatggaggtattcagggtgtaggtacccgggtaaatggtttcatagtcgtagaatttactctggaatataaatgcaaactcgcttttgataagccctttgcgggccaggaattccgctgcctcggacacgctttcaccatccgtcatctggactaccatgtcatggcccggggcctcctccactgcttccgcataaaatatctcatgtccgaaggcatatccctttgccaccgcctcatacagcagcaggacaatcagggcatatacgatgagtttcaccgatatgctgattatggtggttgttatcttgttgatttctctcgttctgttgctcataatccattcctcttgccctgcctggcagaccatgacatccggcgcatcccggcgttgacacgccatgaaatcaagcttctcccggcgttgacacgccgggatatgcgggctgatatccgcaccggtgcctggttatacctccatgatgatcggcaggattacggggttgcgcttcatgcgcttccataaaaagtcacttaaactgtccttgatgatgttctttatctttccccagtcattcacacggcggcccatgcagtcatccaccgcattaaccaccacggaatgcgcttcttccagcaggtcctctgattcccttacgtacacaaagcccctggacacgatgtccggccctgcaagaagctggttgctgtgcttttctaatgtgagcaccactacaataataccattctgagccaggttttgtctatcccgcaatacaatattgcccacatcgcccactccaaggccatctaccaggattccgccgcaggtcacatggtcaatcacctcacaggtttccccgtccagggcaaccacgtcgccggagttgaccagcactgcattgtccttgtcaacgcccatgaactcagccagttccttctgcgcaatgcggtggcggtattcgccgtgtaccggtattgcgaacttgggatggattagggaatatattaatttcaaatcttcctgacaggcatgtcctgaaacatgggtgtcctggttaatgatctttgcccccttcatggacagttcattgaccacgttggaaacagccttttcattaccgggaatcggggtagagcttaagacaaccacgtccctgggtgtgatggaaaccttcttatggatgccggacgccatgcgtgaaagggctgccatggactctccctggcttcctgtggtaataagcacggtggattccggcggataattcctcagatgctcaatatcaatcagggtgccttccggtacattgatataccccagcttgctggcaatgtccatgaccgtcaccatgctgcggccttccaccaccaccttgcgcccatacttatacgccgtgttcaccacctgctgcacccggtccacattggacgcaaaggttgcaacaatgatgcgctggttcttatgctctgagaaaatgttgtcaaaggtcttgcccaccgtgcgctcagacatggtgaatcccggccttgtggcattggtactgtctgccagcagtgccagcacgccctttttgcccagctcggcaaaacgctgaaggtcgatggggtcgccgaataccggcgtgtagtctatcttaaaatcgcctgtgtgaagcacgattccaaccggcgagaaaattgccagtgcggacgcatcctggatgctgtggttcgtcttgatgaattccaccctgaagcagcccaggttcacggactgtccgtgcttcacaaccttgcgcttggtgttcttcatcaggcggtgctcctccagcttgtgctcaatcagcgcaatggtcagcttggtaccgtatacaggcacgttaatctgctgcaggatataaggaagggcgccgatatggtcctcatgtccatgggtaatcacaaagccctttaccttgtcaatgttctgcttcagatagctgacatccggaatcaccaggtcaatgcccagcatgtcatctcccgggaatgcaagtccgcagtccacgatgatgatgctgtcctcatactcaaacgcggtgatattcattcctatctgttccaggccgcctaaggggatgattttcagtttccctttgccatccttcttgctgtccctggaggcctgtctcaccggcgccagcaccttcaggtcctgggatgcaggtgctgctttggccgcagctgtcttggcctgggaccgggatgcctttgcagttccctgaccggaccggttgtcctgccgggatgtcttggccgtcttatcctgctgggacgtcttggctgccttgtcctgctgggacgtcttggctgtcttctgctgggatgccttggacgatgtctgggctgacttggatgcggactgggctgctttggccgatgcctgtccactgccgtccgctgcctgctgctttgcctgtcctgcctgcttggcggtttttgacgcctgggcgctctttccgctgcggcttcccctctgtccctggcctctgccggaacccgaagcatccttgtccgctgtctccgcagtacgtccgccctgctccttggaaacgctctttctctgtgccggccttctgttctgaggcttcttagcctgctgttccggcgctgctgcctggtctgatgccgctgcctggtctgatgcggctgcctgtcctgctgcctgctccggtgcgcccgcctgctctgatacgactgcacgctccggcgccgctgtctgtactgatgccgctgtacgctccggtgccacggtctgtcctgatactgctgtctgctccggtgccgctgtctgtgcggccacctccggcatgttgtctttttcttctaaattcaaattgattcctccaatctctatttctcaagctccacatctgcatcgcttaacagttcctcaaacacgcccatgaggccgtccagttcgcggtcatcttccacaaactcataaacggcttcagcgtcctgctgcccggatacatcctttaaaatgtaacactctccgtcctgatcctccggcgcatctgtcacaagcagatagtttactgcattgattcttgtttcctctaacacataaaaatccacggattctccggaatccgttatcattgttatcatatccgtcttatctttcattgttttctcctaaaccattggacaggctgtccagatatccctgtaagatcatggccgccgcaatctggtccacgctttcttttctgtgttccctgcgcacgccgctttcaatcagcaccctgctggccgccacggttgtaagacgttcatcccagagcaccacaggaagacctgtccgtctctcaagggatgccttgaattcctctgtcttcacagcgcgctccccaagagtattgttcatattcttaggatatccaagaacaatccgttcaatctcatactggccaattaatgcctctattcttgcaagggtctgcctcagtttattttcatctttccgcgtgatggtctccactgtctgcgcagtgatacctaaaggatcgcacaccgccaccccgactgtttttgagccaaaatccagacccatgattctcatattcattttcctccgttatcatataaaataacgcacaacaaaaccagctggctgtccaccaactgatgcatccctgtcttatcttacatatccgtacattgccgagaaggcccgcataacgggccttcccatctttcgccacggtgtgcctgaccgtgcctgtcccaatcctgcctcttcctgataccaaaacgtgtctcatcattcgttccacgtcctggttgggcatcacgggtacagcgctccgtccggcatcccctgaaccgtacgcctgtcacgaaagcatcttcatgccttaatacgtgtctggaaaggaatccgcagacacgtcctaccgcaaacgggcatcaatatacacagccatcagttcttccagaatctcatcccgttcaaccttcatgataaggcttctggcgcccttatggctggtaatataagtcgggtccccagacatgatatatcccactatctgattcacagggttatatcctttctcggtcaaggcaatatacacctgctccagcacatcgcttacttctatcttcttgtcctgaacagcttgaaaatattgagtttcacttatattgcccatgtcatcacgtcctttaagtattcttctctattctacattatattttcctattcggcaatagataattttcttaattttttctaattattgtcatgtatttgtaaaatttcgcataatatttccgtcaacccagggaaatgtttctatttttggaaaaatatataccatcaacaatcctgcattttcctgacttccagcaactcccctgtcagcaatctgactgcatcaagacagaggatctgaccagataatacattttcctccccatccttaacaggaagggccgccttcacatactgcggggtatggcccgtgatatatttcctgccatccacctccgccacgtcttcgaagagtacggatacccggcttccggcaaaatgttccctgtattcccgcgacatggaggcttccagctccagcagcacatcgctgcgctgcgccttcacctgctccggcacctggtccggcatcagggctgccctggttccggcccgcttggagtatttaaatacatgcatttcataaaaatgcacctttttaaggaactcccttgtgatttcaaacccctcctgggtttctcccgggaatcccacaatcacgtccgtggtaatggccggatgatcaaaccatttccgcaatatgccgcagcgccttaaatagtcctccgtggtatagtggcggttcatcctctttaatgtggcgtcgcagccgctttggagggacaggtggaaatgcgggcagaacttagccaggcccgccaaagcctctgcaaattcctccgtgatgatccgcggctccaacgatcccaggcggatacgctccagtcccggtatccggtggattcttcctatcaggtcaagcagggggccgtggtcccagttaccgccctgtaccggccctccctccctgtgttccatcccataggagctgaggtggattccggtaaggaccacttccttgtatcccctggcaaccaggccttccacctccgcctccacatcttccggcttccggctcctcacccggcccctggcataggggatgatgcaatagctgcagaactggttgcagccgtcctgcaccttgatgaacgcccttgtgtggtccgcgatattgtccacgtgaagaggctcatattcatcggtgcccccgatatccagcacgtgtataccggattttggcccttcatcctccttaagcctgccctccatatattcatccaggatctgtaccagctggccctttttgttattgccgataatcacgtccacacacgcgtcctccttaagcgtgtccgcagccacctgcacgtagcatccggccgccaccaccacggattccgggttcagcttcttggcccggtgaagcatctggcgtgatttcctgtccgcaacattggtcacggaacatgtgttgatgatatagacatccgccttttcatcaaagggcacgatctcgtatccgtgctccctgagctgctgctgcatggcctctgcctcataagcatttactttgcatcccaggttgtgcagggctgcttttggcatgttaaaacctcctatttatcaggtcatggccagcctccatcccccgattgccgggggcaatgtactgccataaccaatttaccagtttcttactgaatttttcatgcaatctcactattgacttttacccccgcggtctgtagtattaaagcaaagcagttatactaaactgcaattcaattcacacacaccacaaggagggttcttcgtatgaaaacagttcgcatttcgttaaattccattgacaaggttaagtcatttgtaaatgatttagctaagtttgatgttgattttgatttagtttccggcagatacgtgattgatgcaaagtccatcatgggcatcttcagcctggatctgtccaagcccatcgacctgaacatccatgcagaaagcaatgttgaggagattctgggcatcctgaagccttacatcatctaatcgttgtcatacatcccacggcggggaccacaccgcatggtttaacaaggaaagaagcaagagtctgctgacgcagactcttttttatatttcctgcaatccttggctgacggatatgtcctgcctttttgcgcgattcggacagaccccagagcgtgtttgaaaattgcttcccgacagaccccagggcgtgtttgaaaactgctttccgacaggccctagagcgtgtttgaaaattgctttccgtcggctgtgcgtcccactttgtgggagatttggtcccgatgatggaggcgtagcgggctacgctgactgaatcggggccaaatataccgcgaagtggggcgtgcagacggcgggaatgaattttcaaacacgctctagccctggcagaggatctgctccgtggtagcaagcgctgtctccaccagtccgtcaatcttttcttccagatgacgttccgagctgtggattacattgatgttgggctttgtcacgggatgctttgccacgaagatggtgcagcagtcctcaaagggctggatggatgtctcataggtgccgattttctcggatacgtccacaatctcctgcttatcaaatccgattaccggacggaatacaggcatggtacacacttcgttggtggctgccagggactgcagtgtctgggatgcaacctggccgatgctctcgcctgtaatcaggccgatggccccgttctgtcctgcaatggtctgggcaatgcgcatcatatagcggcgcatgatgatggtcagttcctcatgggggcatttatcgtagatataaagctggatatccgtgaaattcaccacgtgcagcatgattggcccggcgtagcgcgcaaccagattggccaggtccaccaccttctgcttggcccgctcgcttgtgtaaggcggcgcatggaaatatacggcgtctatcttcacgcccctcttggcaatcatgtaccctgccaccgggctgtcaatgccgccggaaagcagcagcatggcctttccgttggtccctatgggcatgccgcccggtcctgggatcatctgggagaacagattgattttctggcgcacctccacccgcagcagcacgtccggatgatggacatccaccttcatctgtgggaatgcttccaggattacctcccctaaatccctgttaatctgatccgaggtcacaggatactgcttatcccctctcctggcgtccaccttaaaggtaaggttcttgtccgggtaaacctggtccatgtattcctttacatgatgtttcaggttttcataatccttgtcgtcaatctgcaccatggggcagatgtccgcgattccgaacacgcgtccaagggcttccacggtatcatcgtaatcgtattccccatccgccttcacatagatgcggccggattcctttgtgacctcgaactggccatccacatcccgcagcgcataccgtatctgtttcatcagggcatcctcgaacatgtagcggttctttcccttggtgccgatttccgcgtacttaattaaaaatgactggtactgcatgttttacctctttctttcattgttgcggtgtcatttatcctctgtgatatttcctgagtacgggaagaagtccttccagcgcctccatacaataatcaatctcctcttttgtgttaaacagcccaaaactgaacctgagggtggaatccagaagttccttctttaccccgatggcctttaaggtgccgctgattgcagggtggttggatgaacaggccgaacccgaggacacgtagattcccttgtcctccaaggcgtgaagcagcacctcgctcctgacgcctgcaaagccggcgctgacaatctggggcgcgccctggctgccttttaagctgttgaccgttaccccctccagctgttccatcctgtctatcatataatccttgaggctgatgatataatccacctttttctggtggtccgtgtacatttcccaggcagcagcgcccattccggcaatccccgggacattttccgtgccggagcgcaggtccttctgctgtcctccgccgtagagcaggggacgtatcttcacccgttcgtcaatgaacaggaagcccacgccctttggcccgtggaacttgtgggcgctgacgcttaacaggtcaattccctgtttctttgggtggatgaccagcttgccgtatgcctgtatggcatccacatgaaggaggatggccgggttcttaccatggaccagggaggcaatctcttctaccggctctatggcccccacttcattattcacatacatgacggacaccaggatggtatccggccgtatggatgcttccagctcctctaaggaaatgtgtccctggccgtccacggacagataggtcacctcgaagccctgctgctccaggaatgccagagggttatacacggaggcgtgctcaatcctggtgctgataatgtgctttccagccctctggttggccatggccgtccctatcagggccatgttattggattccgtgccgccggaggtaaagaggatttccttatccttaaccttcagggtctttgcaatcctggatgcggcctggcgcacatactgctctgcctccatcccctttttatgcttggcagaaggattgccgtaatcctctgtcattacctttaccaccacatccctgacgctgtcaagcacacgggttgtggcggaattgtcaaaatatacttccatggtctgtctcctatattctatctgcctgcccttttacgggcctatagcctgtcatccggccgcactgcgggccttttgagttcatgcagcccgcctttcagctgcactactggccttctgtcactacagcccgccctccagccgcatcatgagcacggacagcatggcaagtcccgctgtctctgtcctcagtatccgtttcccaaggcttaccgggcgcacgccctttttcagggcaagattgatttccgcctcgtcaaacccgccttccgggccaatgaataccgcaatatcctgcccaggcccaacgcgggaaagctcctgcctgctgccttccatcccggcttcgtgctcatatgggatcaggcgcagggcgaactgttccttctctatataatcaaaggcctgtcccaatgtcatcagtcccatgacctcaggcatcaggctgcgccctgactgtttggccgcgctctctgcaatggcctgccaccgcttgcgcttggcctcctccttctttgcatccagcttcacaaccgcattcttcgtggacaccgggacaatgcacgccgcccccagttccaccgctttctggatgatcaactccatcttatcagatttgggcagcccctggaagagccagatcctggaaggcagttcccttccatcccggtccacggacacaatccgggcttcaacgcaatcgctgtccagggatgacagggcgcagcggtaatccgttcccgtgccgtcactgatcagcacctcttccccggttttcatgcgcagggcatttttcatatggttcacatcaggacctgtgatgcgtatacaatcccccatgacctgggccggggccacaaaaaaatgatgcatggcttacctccaatccatatctagtgctccgtccagacagcacgttttctgcctggatggagcactggcttcggtgtcatcagcgtttccttgctgtcacagaaacccattcgccctgataagtcacttccacaagttccagttcctcacattttgcaaatgcagccttaaccgcctcttccttcatattgatgatgcctgaggtgatgaaatagccgccctgcttcagatgggccggaatctcgttgaccagcaggatgattacatcagccaggatgttggccaccactatatcgtacctgtcatagccggcccagtccttgacggatctgtcatcgatgatgttgccctgtatcacatggaacctgtccgtggaaatgctgttggcctccaggttctctcccacggcagtgatggcattttcgtccagatccgtgccccagacttcctttgcccccagttttaaggccgtgattcccaggatgccgcttccggttcccacatccagcaccagggtgtcctcatccacccgcttctccagctgtcggatacacagctgggttgtctcatgcatgcctgtcccgaaggcagtgccagggtcaatctgcaccagaagcttgtccttgtgttcctccggtatggtctcccaggtcggcttgatcaggatatggtccacggtaaacggcttaaagtactgcttccagttgttaatccagtccttatcctctgtctcgccagcggtgatggtcctggcgcccaggtcggtgaacaggctcagctcatccagccccgcttccacattcttaaggatttccttcacatccgcatcgtcatccaggtaaaagctgaccttggcgattccctcgtcaggcggaagctccggaaggatatcgatgaacatcccctttgtctccttgtcggtcaggggaacattgtcctctatctcaatcccctcaatcccaatatcatcgaacatgctgctgaccaggtccaccgcttccgtggtggtggttaatgtaaattttttccatttcataatgcatactccttttattttccgctgatgatcttgacaaacagcacggccagtaccagaaggacaaccggacgcaccacctttttcccattgtgggcaaccatgcccgctccgatataatggcctgcgatagagcagaccccggccgtaaggcccagcgggtaaaaaacatttccagtggcaatgaaggttacaagggccgctatgttggacgccaggttaatcacctttgtctgggcggacgcgcttctggtatccagtcccgccgccccggtcaggatgaggatcaggaaggttcctgttcccggtccgtaaaacccgtcatagccgcctataaaaaatgcagccgcgatacagattgcaaatacctttgcctgtgggatggtgcctgtcttttcattttcccccatgtccttattccttaatacatagaatgcgacaatgggcaataccactatcatcatgtgcttgatgacttcccccggcaccatcagggccagatgggcgcccagggctgaaccgatgagcgccgccacggccgagcatacggccatgagcattttcccgcgaagatagccgttcctggcaaaccgggccgtggacacgacggttcccatggcggaactcattttgttggttccaagggccatatgggcgggtacccctgcaatgagatatgcaggcaaggaaatgagcccgcctcctccggcaatggaatcaaccagtccggccacgaacacaagcgggcatacaatgagatactgtatcatgatcttatcctcttttccgtaaaacaacctttatattatcatatattaaaaccactggcaataagaggcaatttttttttgcaataaaaaagcaggatcctgcattaacattatgaacggatgaaaaacaactgtaagggtccggggattccggcacatattaaatcagccgcccccgccgcactgcgggcaggcaggcataagaaattcccagattgcattacaactccatcacacactccggatgggacggaccccttgcaggattttcattttaccaatgaaggatatcacgaaagagaatgagtttgttctggtcttaacaaaagataccatacgataaggacagaggaccgcgcccctgcttgccgcaggaggacggtcctctgtttttatgattgggcgtcctgttttttcaggatcctttttagataagcctcatccagcaggttcactgtctcaaaaacccctttgtaaaacacggcccagttattgaatacacagggcagtgccttcgctttttccagcgtatccaccggaatcagggatacggggacatcattgatcctgcagaactgttttatcctctcaatgttctgggggatataggggcattgggcatcgtaataaatggtcaggtcctggctttcgatttcctgctttttaacgtttggtgcgaactttggcgttgtcccgtcaaaggaaagggcaagaagctcatatccgtcatccgtggtatcggccacctcaaaaccggacttcctggcaaaggactggtcggaaagccaggatttctgtttttttgccccaagcatgcagacgccggatttccctttctccctcgcatcggccaggcagtattccatcagcgcctttccatagccctttcccttgtaactgcccgaaacccacaggcagtacagatagtaataattgtccccaaggatggggacccaggcggtttcaagaggggcatattcaataaaaaccactgccttttcatttaacttcctgaagacatggccttccttcagccgttccgaaagccattgccgctttgcctcaatccccggatggggctttttactgcggatgatacagcataaatgctcatgggcaaggttctccgctgtcaggttgatgaaatcagtatccacaaagtttccctctctttcagttttctgtccgggcagcatgggttctgcttcccagggagtactcgaaccggtaccccagttcatggaggatatccaggccgtccctgtataccagaatcccccgggaggatggccccaggcggtattccagcagatagcgcagcagctccgccacgaaccggggctggttcatattcacgataaccggtccgccgtctttcacagccggcaggcctgcgttaaacgggcacttgccgatttcccatccaggcgaacggaaatacaggattatcttcagcttccggtccacggagcggaacacaagatgggacggctcctgccagtcatagtcgtcaaaggtatatttccactcatattcatgtccatctacaacaatcttccggaataaagccatttcccctcctaatcatatcaaaatcctgccgcctccgcgttttaccggatcagcgccgcggctgcgtcctactggatcagcgccccgtccgcccccacctgatagccgtcaggggtggtggcgttcacaaacagccgtcccatggtgccgtctgactgcgtgttgaaataataggacctgccgtcaatgacctgccagcccgtgcgcatcatgccaagggtgccgtcatccacgggattcagatagtagcggttgccgtccccatccgtaaaccagcccgtgaccatgtacccgctctggtcaaagcggtaccagcggctgtgtatgagctgccatccattggacagccagctgcctccgtaaagctggaaccaccagccgttggggctgtaacgccagccctgtccgtactggacgccgggacctccgctgtaataccaccagtcgtcgtcatcgtcccagtcatcccagtcatcgtcatcccagtcccaccagtaatccgggttgaattcgtagctggacgtgtccggcacattggtgttaaagccgggatatgcccttaccacgttgtccgaggtgacctgggcattgccctgggtgcccgatggcccgccatagtccatgaccccggacgggcccacgccgtaatcataccctcccgggccccagccatagccatagctgccgggggatcctgtgccgtaatcatagtccacaccagggccgcccctgtgatacacgctgcttcccggcccgtaggccattgccgtaaccggcgttcccatggtgaatatcatggcggctgtgaacagcagggcgccggaataaattttcctcatatgcttctcctcttgtctgaatcatttcaatccacgctcggtatattgtcgaagtgcaactgcatcctacgtagatgcgtggttgacctcatggcagtaggggataccgattactctccgcccaccactgccgttaagtttgtttttggcaattcatttcaccaccttagaggatgggagaatccttgctaatatttgttgaaacaacattattaagaagtataccacaaccacattgacattttcaacacatgagcatacaataattgcatatgcaactattgctcatgcaattcagttccataaagattaaatgcaacaaggaggaatccggaatgaaggattttctaaagtatctgcggccatacaaaagggatgccgccctggcagtcctatgcatcgagctggagactgtgtttgagcttatcatcccccttgtgatggcgtccattgtggacgtgggggttgccagcggcgaccggcactatattctgatgaaggggctgcagatggtgttttttgccctgatatccctggtgttggggcaggggtcggccatgttctcggcccggtgcggccagggcgtgggcgctgagatccgcaaggcggagtttgcaaagctccagcagttttcctttgccaacacggaccatttcaggagttcatcccttgtcacaaggcttaccagcgatgtgaccaccatacagaactcccttgcaacgggcatgcgcccggggttccgttccccggtgatgatgctgacagccatggtggcctccttctatattaacccgaagctggccctggtcttcttcgtggctgccccggtgcttggcatcctgctgttcctgatcatcagccatgtacggcccctgtacggagtgatgcagggcgccattgacctggtcaaccggatcatccaggaaaacctcacggccatccgtgtggtgaagtcctatgtccgcggggattatgagatacagaaatttgaacaggtcaataccaacctgcgggacaccgcacaacacgcctttggcctggcagccctcaatatgcctgccatgcagtttgtcatgtattccaccatcctctgcatcctttggttcgggggcaggctggtgaccgtgggcggcgtcaaggtgggcgagctgacgggattcctcagttacgtgcttcaggtgcttaattccctgatgatgttttccaatgtgttcctgatgaccaccagggcgctggcctcctggaagcgtatctcggaggtcatggacgaggaaatcgatattaaggaagacatggccctggacctgaatgtggagcagggtgatatacggtttgaacatgtgtattttaaatataataaggatgcggccgagtatgtgctgtctgatatttccttccatatcaaacccgggcagaccgtgggtatcatcggacagaccggggcggctaaaagcacgctggtccagctgattccaagactttatgaggcaacctccggcacggtctatattgacggccatccggtccaggaatatcccttaaagcatctgagggattccattgcaatggtgctgcagaagaataccctgttctccgggaccgtgaaggataacctgcgctggggcaaggaggacgcgacggatgaggaaatcgaaacggcgtgccacattgcctgtgtggatgaattcattgaccggctggaacggggatatgacacggagcttggccagggcggcgtcaatgtgtccggcggccagaagcagcgtctgtgcattgccagggccatcctcaaatcgccaaaggtaatgatactggatgattccaccagcgcggtggacacggccacggaggccaggataagggaaggcctggcgcagtacatgccgggaaccaccaaaatcatcattgcccagcgcatttcctccgtgcttcacgcggaccagatcatcatcctggaagatgggaagatcaatgcgtccggcagccacgaaacgcttttggcaacgaacaggatttaccaggaaatctattattcccagcaggaaggggcgaatctgtaatggcaagaatagcaaattataacagaccgaaaaataccagacgcacattgatgcagatgttaagctaccttggacgccataaatggtatatgctgatgattgcgctcctggtcacggtcagcgcttcggcaagcattttgggaacctaccttttaaaaccagtcatcaacaactatatcatccccggcgatataccgggacttgtgaaaatgctcatactcatgggaatcctgtacctgtgcggggcgctgtcctgctatgcgtacaaccagatgatggtccacatttcccagcaggtggtaagcgagatacgttccgacctgtttgtccacacccagcgccttcccctgacctactttgacgcccatacccacggggaactgatgagccggttcaccaacgacgtggatacgatcagcgaggcgcttaacagcagctttgccatgatgatacagagcttcatcaccatcaccggcaccctgaccatgctccttatactgagctggcagctgtcgctgattgtcatggtcttcctggcccttatgatactgttcatccgtttcaacggcagacggagcaggaaatattttgtacagcagcagaaataccttggaagcatcaatggatttgtggaggaaatggttgccgggcagaaggttgagaaggtatttaaccacgaagcccaggattatgaggagttctgccgccgcaacgaggccttccgggcagccgccaccaaagccctcacctattccggcatgacggtccccaccatcgtttccctgtcctatatcaattacgccctgtcggcatgtgtgggcgggctttttgcactggcagggcttacggaccttggaacccttgcatcctatctggtgtatgtgcgccagagcgccatgcccatgaaccagttcacgcagcagattaacttcctgctggcagccctctccggcgcggagcgcatcttcgatatgatgaacgaaggacaggaactggacgaaggcagcgtgacgctctgcaatgtggcggtggacgaaaacggggaaatgaaggagtgcagcggattcacaaaggactttgcgtggaaggtgccggccggggtggcggtatcagcggatgcagacccaaatgcctcatccttccgtcttatcccactgaaaggcgatgtgcgtttcaaccaggtggtgttcgggtatacgtctgaaaaaaccatactgaacggcatcagcctatatgccaaacccgggcagaaaatcgcttttgtgggttccacaggggcaggcaagaccaccatcatcaacctggtcaaccgtttttatgaaatcaacagcggcagcatcacttatgacggcattgatatcagaaatattaaaaaggatgacctgcgccgctccctgtccatggtcatacaggatacccatctctttaccgggaccattgccgacaatatacggtatgggcgcctggatgcagcagatgaggatgtggtgaacgcggccaaggttgccaatgcccactccttcatccgccgtcttccccagggatacgacaccatgctccacagtgacggttccaacctgtcccagggccagcgtcagcttcttgccattgcaagggccgccatctcccgtccgcctgtgctgattctggatgaggcaaccagctccattgacaccaggacggaaaaactcattgaaaaaggaatggacgccctgatggacggacgtaccgtgttcgtcatcgcccaccgcctgtccacggtgcgcaactccaaggctatcatggtattggaaaaaggggagattattgagcgtgggaaccacgatgaactgctggaacagaagggacggtattatcagctttataccggacagtttgagttggaatgaaccattatggaaaggaagtctgtactatgattgaacgttatcaggtccgccgcctgcttgtaagggcggagaaggcgcgtaaacgccttctccagccgttctttaactccatcggccttacctttggccagggccatgcccggatactggattccctgctggtcaaggaccatgttacccagaaagaactggcagatatctgccatatggatgtgaccaccatgtcccgttccctggaccgcctggaggaatccgggtacctggtccgggaacgggaccctggctgccgccgctccttcctcatctgtctcacagaggcaggtgtggaggaagcagataaagtccatcagatccttgactttgcggacaggcagatatggaagggcctgtccgatgaagagatggaacagttctgtaccagcctggaaaagatatgtgataatctggagaactgcgatacgttaaaagggccgttttgaatttattcagccaggaacgtgcggatgttatccagcaccttggcgctcagaaggtcaaaggcctgcctggtccttcctgccgatatgtgggcgcagaatacgtgaggatgctttataagctctccggaaggatctcccaaagcgccctccgtgtcgcagacaaagtaattgccttcccggtccagccatgctttaagcgccgggatgtcaaaggccggccctatggacgtgttgaaaaggatcttgcccgtgccaaggtggccgaactcctcctcgtggagcaggatggcgttcttgttcaggcatgcgaacaccacctcgctgtattccagaagttcttttaagggacggtatgtcatgccctgggcttccctgtccattttcctggaacggctgtaataggaaaggtcggcgcccatgaacttcatggcgtccgcaatcattccgccggaaacgcccataccgataatacccactttcaggtccgtaatctcaatgggcatttcccggaacatgggacggtcaaagccgtgaaggaaacgcaccagttcactgaccacatattccaccactccccggtccccgtaatcccggattcccagcacggtgatgccgttggccctggcgcatgcaatgtccacgttggcgctttcctccgagtaaaggctgcagcacatgccgatatagcggatggaaggacagctttcaatcacatgggcgctgattcttgacgtatagcttacaaggacaccgtccgcatccccaatcctttgtatgatttcctggtcatccccagggatatcttcataaaacttaacttccccggcataccggcgcagttcctcttctgcctttggaaccaggttcaccggctcaatcgcaacgattttcttaaacatatggattccttctcctgttcttatttattttcctgaaacaatgcctgcagattgtcagaacacgattggcgacacaaggttcctgagcaccgccaccacactccatcccgcaatggcgctggtactggaatagatgtccacaaccgcctttaccccgtctatctctgcggttatcttatggtcatcccctatcattccgggcacgctgaaaatgtccacgctggtgtcctccggtccggtcgttgccagggacgcggccaccgctacattcaccttggttggcagtatggagattgcctccttggcattgcctttgaaaacctgcttttctccctcctccgtcatcagtgcatcatcatacagaggggtattcttaagggatgccggtcccttcctggtgcagatgccggacttggcctgacccatcagggatacggtgcgcagcacatcaaacccgcccactgccccggaagcaatatgtacttttgtatcatgctccgtggctgtctcttttatcttatcatacaatgccttatctgcaaatgcgccgatggaaagcacaatcagatccacacccgaggacaatatcttttctgcgttgtcccttatacattgtacggatgcggcctctgccacgacatcgggtttcagggccagcagttcctcaaccgtgccgcatgccttacatccgcctcgtccagctatggcggcagtcttatccggggtgcgtcccatcacccccaccaactcgtattcatctaaaatgccgctcagataaccgtccactataattccggccagatagccatttcccataatcccaaacttttttttacccatgatatcctctttcttttttaattttacacacatactgataccttacaccgaaacagctccaccaatcctgcgggtgcaggattgctgaagctgcccatacgtaacagtccaaacggctatttactccgcttctaattggtatagttatcaaaatacccctgtaccaggatgatcggagtccccttgtccccggagccgctggtaaggtcgcagagcgaaccaatgaggtccgtaaggcgtcttggggtggttccctgggaagacatgtctccaaccaggttggacttcttctccttgattctctgtgagatggcgtccttcagtgcttcgcctgacaaatccctgaagtcattgtcagccaggtattttaacttgacttcgttgggggttccctccagcccttctgtattggcaacggcaacacatgggtcggccagttcccagattttccctaccggatccttgaatgccccgtcgccgtataccatgacttcaacatgctttcctgtcctgtcaagcatctgcttctgaatatccagtaccaggtccgtgcattcccttgggaagagcttgatgctgtcctccgtagacttgttggatccgagaagcccgtacttctcattgcatccgcttccattgaccggcgcgttcaggatatcgtccattccgcacaccacctctgctccggccgccttaaggatacgtttggtccttgcgcgggaatgtatgtcacaggtcaggacccggctggtatggttaaggatctccttgggattattggcaaaaataacttccgcctccgcgcccgcgtccctgatgatctgacagtaataatccacatagtccactccggtgaattcatgcctgttctccccaaaaagctccctgtaacgctccagggtaagcacgtcgctgtatggattgattccggcctcatctacctggtccagggataccagtgagttgcccacctcgtccgtgggatagctaagcataaggacgaccttctttgcgcctcctgcgattccctttaagcagatggagaaacggtttctggacaggattgggaatatgacgccgatggtccctcctcccagctttgccctgacatcctctgatatggcctgaatcggggcataatttccctgggcccttgcaaccacggattccgtcacggagatgacatccctgtcacggatttcaaagccctcgctctctgctgcttccagaacactgttcaccacaatatctgccagattgtcgccctcccttatgattgggcagcggattccccttgaaactgtacctacttttctttccatatgtattgtctcctgtacatgatatttatcttcaactattgtattatagtataaaaaagcggattgtggaagtgtttcatataaattaaatgaaaatcaaaatacctttacaaaatactggcggcttatggctgattcgtgataaaatggacacaaacgtttacaaggaggttcccatggtcacactgcacctggacgatgccgtcatcaaaagcctgagcaacaatgagctgaatattttgaaattcgtctatgagcatggcgaggatgtgccggacatgagcatccaggccctggcctcccaggtgtgctactcctccgcaaccatcctgcggttctgtaaaaagctgggatattccggcttcgcagaactgaagtacgcactgagggccgcggctaagaaggagccatcccggcctgacacccataaggcccaggattttaccacctggatgatgatggacagcctgtgttctgatattgaagggacctccaagctgatatccgaagaccagcttggacgcaccttccgctattttgacagcagctgtcccatctatctctgggcgcccggcggaatcaccagcatactgagcgactattttgagaaacttctgttctccatcggacgccagaacgtatataagattgaatccgccaaaatgggggaacacatattaaggaatgcccataccgaatccctgctgatacttatcagcaccacggggaatttcgggccaaccgtacgcctgggcaaaattgcccgcatgaatgatataccggtcctctccattaccccatacaccagcaacgaggtggctggcctggccacggtcagtttccgctttttcaccgaccagcgggagaaccgcggagcggagttcacctcaaggctccccgtattttatgtaatcaacagcatcatacgctgttatctgggttataaacggtccggagaacagcctcaaggaggaaaccatgattcccatatttgaaaaagcccaccagctggaacttaccgggacagaggaggaaatcctccaatattttgaatccaatctgcctgcttccatatacaccagcctcaatgacctcagcgccagcctctatacctccaatgcgaccattgtccgtttctgccagaagctgggcctgaagggttataatgaatttaaataccaggtacggggcgagttaaagcagcttcatatgaccccgacttcagatgacctgatgtatcataccctggccctgttcagggataatctggagcagattgacgttgcaaagctggaagagattgcaggcctcctcaccagcgggcggcccatctatatatacggctccaacttaagctcactggccgccaaatatcttcagaccgtcctcacctccctggactacccctgtatcctcattgagtggcagcgcctgctgaacgggcttgcctatgaactcagcagcgacgccgtgctcttcatcatcacggcccacggggatgccagacgctacctctccgtgttccaaagggccagggaccggggaaccaccacggtcctgcttacctgtgaggaggacagccccctgattccatacagcacaatcgccctctgtacaaacgaccagaatgaagaataccgccatgttgatatcaatccccgtctgggcatcctgaccatcatccagctgctgattgaactggccgcacagaccaggcaggattcccggattgattagattggatggattagaccggattgattcaaatcgatacgtgtccccggcacttatatgaaatcaattttccttaacatatcggttatgtatcttccttttatccatatctgctgggaataggcatgtatggtatctgtcccatccgctgcacggcctttaaatacccacggtttcgaattgctgtccgtacccgtacctcttacaaaaacagacgactgggcctgtttgggaaaattcaatgctgtcatgggaaccccggtatcattaatccgctgcctaccatccttccggtatacatagctttccaccacaccgttgttattgatcttatctgaaatgtccttatatacattcctgattgtcccgtttatcatcccatcatcaaagaccagtctcttgaatcccaggaatacattatcattcagaggcgcagccgtgcatggttcctcaaacatgatgcacagcatctgatgattgctgaaatactcataatagcttgtgtcttcatactcaagggaggaatctgttatttcatccaggtccatggtaaacagtttcatctgctctgtttccataccctttttcgtgacagtaatggtctttgctatcagtccgattttttcaaataattctatgctgctgattcttttggatgttccgccaagcatacgcacaacaattgtttccgttatatgtttgcatagcttatgaatgtccttcacttctatgtcaaatatatgtatcagttcttccacggtccggccgcgatactgtttagtcagcgcgtgcagcctatggtctaattcgctgtatgaattaaattcctcactgagcttttctaatttatgattgtagaagccctggaacaatgtatttacataggatttcttaaaccggaatctgggcgtctgccttggctgctgcttaaatcttggggcaatgtcaatgtaaaacaggtctttctttattttctgatgcagcagcggatataaatcataccggtcctcccggttttctatactgagcagataatcatggacctgggtccagtcattttcaaactttgccaattcatctttatcatctgcaatatcaaggaacttatatcccaaaaccggaaacctgtcatattcagcatagggaaccaccttctgtccgcttttcctgtcatagacatagaacacgaacagcatatgggcaatcttattataaaaatgggattccaaaaatttctcatgttcgatcaccccgatgctgacggctgtcagtgacatgggctcctttgccgcgtatttctccccctgtttattggaaggttctaccccggtgacctttaattccgtatccttataactgccgtccgcctgtaggattgacagatcggcttcctgtgtggaattctgtttcatggacaatacgctctgttcaatgacgcagccggcaatccccttggcaggcacctgtgtgtggaacacatcccttacatccacctccccaagtgttttttcaccgtcaaacacttggaatttccggatgatttcttcccttgtgaaatatttatcatgatattccatggcattcctccatcttatgattttccatatatttgaattttagcagaaatacatctgttttgccatcactaacacagaaaacctcctgatccacataataaaaacaggtcttctaacaagttcatgccttgatagaagacctgccgtatggccaggccaatgctttttacacagcctaatatttcaatacttcccttacatgggatgcaatcccttcgaccttcggtccatagatcacctggatgtgcacgtcgctgggacggacaaatcccatggccccggtcttcttcaataactcatcatttaccagcgccatatcctttaaatcaacccgaagccttgtcagacagttattcaccaccacgatgttctcgcgtcccccaagtccttcaatgatcctggacgcaaggatatgctgtttctcatcaaggctgccccccttggtctcctgttccggctcttcatcggacacgtcaatggacagctgttttctgctaagataccatttaaacacataatagtatgccactgagaaaaacggtccggtaatcaatacccaataccagtgtgagcctggctggaacacgccccatatgaggaaatcaatgaggccgcctcccgtatttccaatgatgacgttaaacgcggacatcagcatgaaggaaagcccgcccatcaatgcgtggaacagatacaggggaggtgcgatgaacataaaggaaaattccagcggctcggtgatgccggatacaatactggcggcaacgcccgcaatcatcagcgccttcacctttgcctttttctccggcggggatgtcctgtaaatggccagcgccgctgccggaagaccgaacatcatcatgggcatcttgccctgtcccaggaacacggtaaaaggcttaagctgcgagatatccaccttatcaataaactgcaggaaaatgttcaggcagccctccaccccctcatagacaccgccgatggaggtggtacggaaaatgccgttaagcacatggtgaagcccggtgggaatcagcaggcgctccaggaagccgtatccgaatacccctgccagcccggtagcggatatcagcccgcccatgccgtcaatggccatggatacgggtgaccagacaaagggcgccgccaggcccacggcagccattgccagaatgaccacaatcgccacaaaacgtttgcccccataaaaggagacagccactgggaacgtgattttatggtaccggttgtgcagcgcggcagtcaccacgccggtgacaatacccgccaccgcgcccatatccagcgtttccacccccaggatggtagatatcttcagcgccccaaagttcatgaatcctgattggatcatacaggaagaggccactaaaaacgtatagtatccgataaaacctgcaaatgcggctatctccttttcctccctcgccatcccgaaggagatggagatggcaaacaggaccggaatcagtgtaaatacaacacccgcaaccttatttaacgttgagatgatgaaatacagaagctcctgctgtaaaaacggggccgccgcctgtacctgtgctttcataagcgcggaagtcagtcccagtacaataccgcatgcggccagggccgcaatgggcatcagcaggctgcgtcccagcgccgagaaaaaatccattactttattcttccccataatcttactatcctttccctccaaattatcctactgatcatcttaactcaggccacatcccccggtttgcttcaatcagcgcatccagcaccttcctcgccttcttggcatcgttaatcagacggttaagggtgaatgcctccagtgccttctggtaggagttctcaaaataagcatccacaatcagcttctcacaggatacctggttcaccaggagtcccaggttgaactgggggatatttcccaccctcatgggacgcgggccgttggctcccagttcgcacaccacctccaccatggcatcgtcctgcatattggcaatggctccgttgttctcaacaatcaggatgtgtctgtcattcttattgtaagcaatggcctcggcaaccttaatcatcatctcggcatgggcatcggaaatagcatcaaacctgtcccccagcttaccttccctgattacctcctcacactcgccgaatacgcgcttctcccttcctgccatgacctcgtccgcacgggtgaaatcaggatccaggtggctggccttatattcagggtacaggtaatactggtcgtatgtattgggcaggaaatccgggaaatccgccataagggtctgcaccatcccataggtgtccagccaggatttatccctctgctcggcatcttggggaaggaaaccgttccgggcaaccatttccctgattttaggaagcaggtcctcgcctgtgcggctgtcatacatgtgggtaaaccatccgtaatggttcagtccgaagtataccgggtccagattttcccagctgcagttaaggagacggctgcaggaacgcaccacgttctccggctggtcgcagatatttaaaagcctcctgtccccgggaaattcccttcggagcgcttccgccacaatggccgccgggttggagtaattcaggatccaggcgtccggcgcatatctgcggatatcgtgcactgccttaatcatgtccacgcaggacctgagtccgtaggccattccgcctgccccgcatgtctcctgtccgatgattcccatgctcagcggtatatgctcgtccttggcgcgcatgggaagcccgcctgcgcgcatctgcatgaacacaaagtccatcccctcatacgcttccctgcagtctgtggtatatgaaaaatccagttccgggaaccgctccctgaaaaggatctccccatattttccaatgggttcctggcgttctgcatcaatatcgaacagcaccagcttcttcaaagggaattcttccctgagcctgacaaatgacttgaggaatccaagggtaaaggtactcccgcctcccacgatacataaattaaatgctttcattttccttctcctttttcaacgtttatagttgtctgtctctgatgaccttatgatacttcattctgttttgtatgtaaatagttccagattcatacggatggcatcccttattttaatatttatgacttatatagtaatttttttcataagttgtgtggcaccggaacaaacacgcctatgacaaaaggcggccgcaccgattgataatccgtgcggccgccctgattttactttgtaactgcagtccgatcaatatgtatgttagcggataaataactgggtccagtaattaacgcctgatgcgttctggtaatgtcctacgccgatggaggtatagctgctgttcaggatattggccctgtggccggagctgttcatccagccctccatcaccttttccggtgagttctgtccataagcaatgttctcccctgcgccgctgaagttcacacccgcttcggtcagggcagaattaaagctgctgccatccggtctggtgtgtgaaaaggatttctctatctccttggctcttacctgggctgcgctggctgcgcctctatccacggtaagggccggaaggccggccttggccctttcttcatttaccaatctcacgacttcattggcaaatgcgtcctgggaaccgtctgtcccgggctggtccggagcagggttgcccggctggtccggaagcatgccgccgggctggtccggaagcatattacccgggaaatccgggattgggaaatccggggcaggcagactgttgtccgggatattggaacctggaatattgatgcccgggatattaacacctgggaaaccaggcagttcacagttggaaccattcatgctgccgccgatgacaatcatctttcctcccggaatgttatatgtaccggttgctgctaatgcggttaccggaaccgcgcccgctgccgccatggctgttgctgctgtcaaaaggcaaactgataatttcctcatggtatgtcctcctattattacataaatattacatttctgttacaaaaatataataccacataatcaatggaaaatgtttaggaaaccaatggtaaatctggaaatcctgtttccagtgctccatcccaccactcagtgcacgccttcccgggaatgggtctgaacatcaccttccgtcatccgtgctgtgtattttcttcgctttacccgctttcttcttcaccttgggttcaggcagttccccgcaggtctggatgaccagccgggcaaggaagtccgcatcatccagatcctccaccagatacatgcctggctcccctccatgaggagctgccggttctgcgtccggtaaaagcagatggcccgcattggtcattttcacataaaactggttgtcctccacggttccaaagaacttgccgccgcaccagaggccgtattccccgaataatttcttataggtaatcacgcccgcgcccgccagctgggatgcaacatattgtacatatcctaaacttgaagccatagccctcctccttgtctttcacgtgccgggttctgatcctattccatcgccttcagcacctcaatcatctgccttaaaccctctgcattctcttccggtgtccgggtggggtcctgctggtcaaaccgcgcacagggcagggtagcacagcggccgcagtggggcagttccttttcattaacacagcactggtatatgctgcatatctcctcccccctatattccagccagaaaggcttcccgcctatctttggacacccctggcaatccgcaggataatagggacattcatcacatatgcatccacagcacgccactatcttttccataaccatacccccttttttctaatcataacaccacaaacatgacaacagaatgtcatatttatacattttatctgtctaaataaccgattccccatcctccggttgatacagtgtgcgtatcctgcctgcggtctctgccagttcttttctgaacgcctccggctccagcagttctatctggctgcctaggctgaggacccacccaagcagattctccttatcggaatagcctgcctggaacagaagacggccgtcttccatttccttcaggctttcaatcccaaactcttctataatgcgccatttgactgccggctggcagatggcctttacctggaaccttaccggaaacgggcctgtgggttcattttcataagcaggcatattacgttttgtaaaatgctcctggcagagttccaaatccgccatacggttcagtttaaacatccggtaatcttccctgagacagcaatatccccacacataccaggatgaccactggaataccagcgtataaggttcaatgcagcgggaagtctcgccggacggggaaaaataggaaaaccgggtcagcctgcattcctcgatggcttcctggaacagatggattttaggcgtaagggtctctttgtaccaggaggacaggttaatcatgatatggctgtcaacatgaatcagatcatggttccccacagacagcttgtccatcagctgtctgtactgcccggtaaaggatacgctgtccaggcttcggagtcctgccaggatggactgcatttccctggatgtgagcagggttttatccatcctgtacccttccatgatggaaatgcctccgttcacacccctggtggtcactatggggattcctgccttgcatatatcctcaatgtcgcggttgatggtgcgccgggatacctcaaatttatccgcaaggtagggcgcggtcaccttttctttctggagaaggacggataaaataccgatgagacggtcaatcttcatatggctgaaacctcctttgctgcctgcataccttatcttactatcaatattttatttgttcaatttcttttctccaaaaccagcagaaaacacagcagtgaattaccgctgtgttttctgctcttatctttgattcatcttccccggtgcttttctttccgcttttgctgcctgatttcaaactggcgctgtttttcttcttccttctgcctgcggcccttctccttgcgcgccaacttatcctcttccttctggagacttaacgcctgctgggatttggtcccggtcccgtgtgcttccagctgtttcctgatattcctctgcatgcgcttgggattaacctttgtttcctttttcccgccagcttccaccggcgggctgaaccgcagtttattccagttctttaaaagaaattcatatacctcatagtcctttggttctgccccgaatgtgattttgcaggcttccagctttccatcctggatgcgttcatagataccgatccagaaaatgccgtcaaaaaatactgtcagtttacttttttgcataaaaaacactcctcgctttcaacagcaaagaatggacaaccgaggaggcaggttactgacagatttttggaactgcgcccggactaccggccgggactgtgtttttatctttgcgttatttagttttatggtatcattttaccttattgacttcttatttgcaagtattgatacggagattggcacgtttttccctgacccggcactgtcttgcgtaaaaaccggtgaatccagcatccaccatccgcgcaaggacttacaatacgctgtaccagtatattttccagaaaccagcaaatactaaccccatctattatcaaaccaccaatctaacaatacaggagattttactatgaacaaaaacatgcgtatctggattatcggtatctgcgttgcactggtcatcatcatcgtggcagcggcagcgtccatgaacaggaaaaacaacagccaggggcaaaccggaaccacctcggaaagcggggtgacagaggatcccaacgccgcatcctcctccatgtccggcacggacaacggctccatgaacggttcagaaggcacatccatggccgacagccatatggaccattcctcccacggcggccaggcatccggcaatggcgataacctaagccgttacctgaccgaacaggattccatcatgatgaatatgatggatgacatgatgatccgcgaaaaatccggcagtgccgacattgactttttaaaaggaatgattcctcatcatgaggctgccatcaaaatgtcggagagctatctggactacggcggggaagtttccggccttgagaccctggcacaggatatcattaccgctcagaaaaaagaactggcccagatgaatgacctggttaataaatacgaaaaagaaggaaagaagaatcaggaaaatgaagacgcttaccttgcaaaatacagtgagatgttctccgatgattccatgtcccatcacatcaatccttccggcgtcgacaacattgaccaggcatttgcagaaggcatgatcatgcatcatcagatggctgtggatatggccagggatatcctggattattcagagcaggaggaaataaagaaactggcccaggatatcatcgatgtccaggaaaaagaaatcgaacagatgcagaagctgatacagaaataataggaaactccggaaatacggttcatttccagaatgcgtcccctgatgggaaacgcatccaagccgtatttccggagtttttttatccctattccccaccagccagacgtgccgccgtaatccggttcagcactgccatcacaactaccagggcaaccaccgcaaagccaagggctgcctcgcttccggtcagtcctgctatgatataggcaatgaacgctatgattccattgacagcagcatagggcagctgagtcttgatatgttccaccaggtcgcactccgcgcctgtggaggacaggatggtggtatccgatatgggtgagcagtgatcgccgaacaggccgccggacaggactgcaccaaccgcaatataaaatggtatgccgaatgcatgcgccatcgggattgcaagcggcatcatgatggcgaacgtcccccaggaactgccagttgaaaaggatatgaacgccccgaacaggaagattgcagccggcacaagggatgcggaaaaactcatgtcctgaaggaatctgactatgaattcagccgtccccagcccgctgatcatcttacccagggaccaagccaaaatcagggtaatggccacatctgtcatccccttcataccgcccacatataccttgaatgtttcgttaaaatccatgaccttaaacaggcagattaacgccatcaggacaactgccccaaagaaatatcccatggtcagggccacgcggaacgcgttgccgtccaccttcgcgaacgggaatcccagaggcgccagggttccgaacagggttacgaatacaaccacaatcggaaggattaccatgattggctttgcatgtttaagggaatatccattccttgtctcatggacaatttcctccttgaccaggtcagcggccctgttttccttcccagccctcatttccgcctttttcatctgggaaaaatccagcttcgtaaatgccaccagaggaatcatgaggattgcaaggatggcataaaactggaacgggattgcgcggacaaatgtcgtataatcagactccgccaccccaagattctcaaactccgcctgaatcagccccatgatataaacgccccatccgatgaatggaatcaggattgccacaggggacgaggtggaatccagtacccaggccaacttttccctggatatcttcagtttgtcaaacagcggcctgaacaccggtcccaccagaaggggcgttcccaggtccgagaaaaagataaggattccgccggcccacgcgcacatctgcgccttcagcttcgtattcacgtaccggtacacgctttggctgaatgcctgtgctcccccggatttctccatcaatttaataaatcccccgataaataccaccaggacaatcacacctgcgttgtagctgtccgtcagttggacaaacaggtaatcgccaatcatggatttcacggccaggaacggattgcccccgcagaatatcatgacccccacaaatcccccgcagaacagggacaggatcacgttcctgctcctgattgcaaggataaccgcgacaatgggcggcaacaggcttaatgcaccgtaattcatactttcctcctcatgtaacccttattatgtttatacatgaaaatgcataaaccacaactgattttaatggattggggagaaaatagcaagaggttatttccaatttccttcagccctgctgtgtcttcagcctgactgcgtctaaaagcactgccacaaagataatcaggccattaatcatctgcacatagtagctggatacacccagtatctgcagtcccacctggatgacggtgaggagcaggacgccgcccagcactcccaggacatttccctggccgccgctgcacgccacgccgccgattacagtggctgcaatgttattcatgtcataggaggtaccaaatgtggaggtgacagcccccatgtaggcggaaaggaagaatccggcaacgcctgccaggaatcctgagatggtaaaggcaatgatttttatcctgtcaaccttgatacctgacacataagccgcgtcctcattgccgcctaccgcgtacagactgcgtccatagggtgtcttattccacaggatatatacgaatacaaacactgcaaccaatgcaatgggaagggtgggaatgcctgcaacgcttccctgcccgaaccatttgtaggaatccggcatattggtaatggcgcgcccctgggtgatgaccaggaatgcccccagcagggtcagcttcacggcaagggtttccaccagtgccactgctttcagctttgctatcagcactccgtttaaagcgcctatagaggcgcctaccaggaagatggccaggatggcaagcgcggcagggcagcctttttcaagcagcagaagtccgcaggttgcggaaaatgacatcacgcccaacagggacagatcgattaagccaagcatgattgcaaaggcctgggcaaaggaaaggattccaagtaccgttgcctgtgaaaggacattccctaaaatcgtaggtttgaagaagctgggttccaggccgcccacaacggcaaccgccaggaccagcaggatccacacaatattattcagcaattttctttttaatttgaaccattttatattcacttttatccctccatgtctcatacattcacaaacaatggcatttaacccacagaatcacggatgttgattacatcctcatggctcagtccatgattccttacatccttttccaacctgccgtttttgaagaacagtatcctgtcaacggtacggataagctcgtcaaaatcattggtcaggtacaggacggatgtatggtcctcttctgctatcttattgatattttcaataatctcctcacggctcttaatatcaattccaatggtgggttcatccagcatcagaagcttcggaccggtactgaccgtctttgccacaactaccttctgctggttcccgccagaaaggctgttaagtttatcctctgtggagtttgccttaacatggaacagttcaaaataatgctctgatatatccctggatttttccatatccacaaatcccagcttattcttaagcgtggtgtacagggacggcaggctgatattctcacggatggacataaggcccacgattccctccttatgcctgtcataggagacataggaaatcccgtttttcatggcatcggacgggttgcggatccccaccttctcattgccccctatccatatttccccctcggtcattttctccaggccaaacagggtacggcacagttcccttgcgcctgaacctggaaatcccaccagacctgtaatctcgccgcggtatagctttacggacacatccttaaggatatggccggacatgttcctgcattccagcagcagttccctgccgctgttgtccggaagcttttcccggtttatcagttccacttcctcgcctgcaatcaggcttgccagacgttcctcatttagctcaccgccatcagaacctgaaaaggaacgcccgtcccttatgaccgtcacatcatctgacagttccaccacctcctggaggtaatggctgataaagataaatgcagtcccttgggcctttaattcattgacaaacacaaacagttcctgacgctcaaccgatgagagggcggttgtcggctcgtccaggataatcagctttgcgccgccatgcatggccctgatgatgtttaccttcctctggtccactccatttaagttgcgcaccttttcttttgggtccacatccaggccatatttacgcagttctttttccgcatctatgaataatttcccccagtccacaaaaccgccctttttcctgggccatatgcccatgaaaacattttccccgacagtcagttccggaacaatgctggcgtgctgcggcactatcttaactcccatattctgccgttcaaagacagaatatggggtgatatcattgccgtccagcgtaacaatgccgctgttctgtttatagattccggctatgatgttgacaaccgtggattttccggctccattccttccaagcagagagtggatggtccctttttttatggtaaagctcacatccttcagggcctgggttgcaccgaagttcttgctgacatgctcaaccttcaggagtatttcttccatgtttcacctgtcctttcctatggttacccggtaaacaccgcgcgggtcatttcccttctgccttcagtgcagccacaccccagtgtccgtcctcattgacattgctgctgtccagggcgtaaggagggacctgaaggatcggaccggtctctccgtccatgaattcagctgtcttccaatagaaatcctcgttggtataggttccggaggtgggaaccggctcccctttaaagatatactgtaccagcatatcaactgccattggcccatatgcataggcatcttctacgataatcgcatcgtaatatccatcctgaaggaacctgaccgcatccggctccccgtctcctgtgacgaatatcacatgatcctcatcccccaccgggtgccacatgccggcaatctgcatggcttccgcacatcccaggccagggtcatcggatgggcagtgtaccgcatcgatttccttatcgtacttggcaattacattggtcagggcttcctgggatttggagcgctcaccttctccgggcacttcaatcttctcaatttccggatacttatccatcacagcgtcaaagccatccttgcgcaggcgccagcactcggaactcatggcgccgtaaacattgaccacacggcccttaggggaaccgtattttgcttccagcgcttccacaatccgctccgccgccatttccccgcattttaagttgtcaaacttgatggagcagtccaccactgccgtggaagcagggttatccaccatgaccaccgggattcccgctgccactgccgcgttggcagcatcattaagggcgtccgagtcaacggtattggcaatgattgcctttggatgcttggagatgaaattctgcatctggtcattctgaagcgtggaatcgttgttgcagttagccacttccggctgatatccggctgcggtgattgcttcctccaccttctgctgcagcgccacatggaaatactggttcatggttttctgggtataaacaattaatccagaatcatccgaagcatttcctgctgctgattccgaacctgatccggagccggactccgaaccgtccttcgccgttgtctgggcgcttttagacgtggatgcgtctgcgcctgcattggcagctgtcccgctgttgccgcaggcagataaacttgtaattgtcatgattgccattgccatacataatattttcctcataattccccttctcctttatcttggattcctttgtgcctgatcttctatcattgcataaaacggtttgttccccaaacattccatgacagtttttacagctgcattttgcatcagaagcaggtgtacgcgccgtccacgcggaaatccgcgcctgttgtataagaactcatatcccctgccagatacacggcaatggcctgcagctcctccggcctgcccatacggtgtaccgggatcatttcctcccactttccgattaaaggaaccagtccagggtcattgagcgtcatttccgtggccatatagccggggcttatggtgttgacccttacattcttatccgcccactccactgccatgttcctggacattgcaatgacgccagccttggacgccgcgtaggaacactccttttgcgggatgttggtgatatgggcggacatggaggccgtgttaatgatggagccgccgccctgccggatcatttgccttccggctgcctgggcggtcaggaaggttccgtttaaattgacctggatgacccggtcccagtcagccaggttgtcatcctccaccgggacgccgtggccgattcccgcattgcagaatgccacgtccagcctgccgaacgcttccagtatccgggccatcatatcatccacttcctgcggtttggtgatatcggtcttaaccgcgattgttttggtatggtttgcagcttcaatctcccgggcagtcttctctgcctcctccaggtccacatccacaatggcaacatccgcgcctgcttccgccagtgcaatggcaatgcatttcccaatcccgcgtgcgccgcctgttacaaatgccttttttccgtccagcctcattttctcaagaattcccatgattacctcctagttttatccatatatgttttattcccctactatctgcacccgtaccttgcgttccctggcccttgtctggtccatgtcagaaaaatatatgcgcccgaattcccccagcgtcatctccccctcaaccaagggaatggtctcggaacggcctaacagcacggagcgcagatgaccatccgtgttcaggagccactccggcttctcgtccctgagttccattgcattttttgtgtggattggtccaggatgaagatactggccttcattccggcaggtggggaacactttctccatggcattgaccatatcctgtaatatcaacggcgtgtgccagtaggtttcatcctctgagtcctcctgtatgaatacacagcagcttgtatgctgtgagaagacattcaccagcccattgcgtatgcctgactgttccacaatatcctgtaccttttccgtcacatcctcaaagcttaccctcctgtctgtctcaacaggaatgatttcatgatataccgccataatcatcctccttatcgtcctcgttcctggccctggcatgtctgatgccgggcagtccacgcggctgccacggaggcaatcattttctccatcatttcacatggattgtctgccttcatgatcccgctggtggagccggttgcatccgctcctgcttttatgacctcatatacatccttttcatcactgattcctgcgccgtgcagtatcatcatcccaggcgccaccctgtgcaccgcctggttaatcctgtctatctcctccatgtcccctggtcctcttgccccttttccaatcagtccgggggcttccgccagtatcatgtccgggccaagggccgccaccgccgctgcctcctggggcgttcctgcgcacaccagcgttgccagccccacttcccctgcccttacaaccgacctgcggattccgtcaagggtcaggggcctttctgcatggtttaacaggacgcccgccgcccctgcctccttaagggcttccggcagcacggcccctatccccctgccaggataaaccggatccatgtgctgggcaaataccttgatatggctggtggcttctgcgatgggccggatgtccgtgtactgggctgaaaatatgatgtccacctggtacttcctgccggcccggtctgccgccatggcaagttccaaggccttctttccatatatgtatgtcttgggtcctatttcaaaaaacggtttcctgattgtaaatccttccatattgtaaatccttccctaagggcgtgtttgaaaattcattcccgccatctgcacgccccactttgcgggtacttcttatccaatcagtttcctgaggtaatcagccgtttcaggcaatgttagcgccggattcccgcaggtgctgcattccaggttcacaaaccccttgtaccctatctccttaagcgcatcaaagcatgccttccagtctgtcatcccgtgtcccggaagcaggcggttgctgtcgcccaggtggacatgttttatgtattcccctgcatagaggatactttccctgtaatcggactcctcgatggacatatggaagaaatccgccaggacacctgcctcctttaagccaagggactcaaccatgtccctgcagtccctgatgctgtttaagtagggactttcgtagcggttgattccttctaaaagcatttttccttccgtgccttttaatggttccgccagttcccggtacatctcacagaactcctgttcctcctccttccccatcttcgcatacggatggaaaagcggaagaggtgactgcggtccgtattcgaattcaagttcagtcacagcgccgatttcaccgctgatcctggcagccagcttgtacatttccctgctcctcttccttatgtcaggattcctgtccatcagatgcccatatatcccatccccaaaagcgaactcacaaggaacgactcccgtgcgttcctgtaaggataaaagctcctggtacagttcctggttccaatcttcatagtccacaaaaacagcaatgccttcatatccccatcggctcaggttcctggccttttccgtaaggtcctttcccggaaccatggtgctggtacacgataatctcatgaatttccctcctcatttacaacgttgtaattattagttaaaaaattttggctcattgagcctccgtttaaatatttcaaacgttgtaattatcatataatcgtgtgtcggatttgtcaatagatttttattttttcttagttttttgtttattatgctttgttttttgtctttttttcgtgcaaatagcagaagtatccttgattataatgattttacaactggtttttttccagaaattttaaatattctataaaacgactattgacaacgttgtaataaaagtgtaagctgaaaccaatgaaatcatgttaccataaccatgttacataaataacaaaggaaaggggtgaatttatgtattgcagcagatttgcctgcacaatacattcatcttatggccgatacagcttctaataaacctgttacaattaaatccattgccaaggaactgggaatctccttctccactgtctccaaggcacttaacaacaatcccctggtcaaggaagaaacccgcaggctggtcctggacacagccaaggagatgggatatacccccaattccctggccaagggactccggagcaattccaccaaaaccattgccgttattttcaatgatatcgagaacccggccctgacttatattttccgcaatatctccattgaaatggccaatcacggatataccaccatgatatttgattcccagttcagtgagaagcaggagcttgccaatattttaacagtcttatcgcggcagccggactttgtcatactggagccaaccaccaccaacccagagaacctgaacctgctctcaggcattacccagaagcttatcctccagggtgcccgctatgagtccgtaaactgccatcatgtgcatgtggactatgcccagggaggctatatggctgcctgcgagatgctctccaaaggtcatcgggactgcctggtcatcaccactcccctgaccatacccatcagcagccaatttgtcattggaatcaggcgggcctttgaggaatatggggttcccttccatgatgatatgataaaggatacctgtaactcctccatcatgggcggattccagatcatgaacgaactgtgggaccatgaatccggccgtttcagcgtgccgttcacaggtgtcctgacttttgatgatacactggcccacggggtctataaggcagcgtcccagttcggcctgcgggtgcctgaggacatcagcgtcattggattcgatgataatcctctgtcagcattttccatgcctcccctcaccaccatccatcttcccagggaaaagatggcggaaagctgcatcagcatattgaatgctgtcctgctggaaaataggaccgatacctgcgtgttctccttggaaccgtacctggtccaacgcagctctgtatataatctttataagaaaaaataaagcggggcctgggcaacggccatcatcatgttacaggagggttaggtttatgaacattatttccattgatttaggcaccaccaacattaaagtctcggtctatgaccaaaagcttcacccaattgccactctttcagaaaccgtgcagtatgacagggatggggattttgtggaatttgactgcgataggtattttcgttccatcgaagaaatgatacagaaggcggctggcgccgggaaggacgccaatgtcggggatgtggttcagattgtactgacaggtcaggccgaatccctgattctcctggggcaggacaggcagcccatccatccggccatctcatggatggatatgcggtccggcggggagtgcgccctgctgtctgagcattttccagctgacctgtgctatcataccaccggacagccggaactgattcccacctggcccataaccaagatgctgtggatgcgggaacacagacctgacgtattcaggaaaacggcccattaccttcttttaaaggattatatcatattccggctttgcgggcgtatggccggtgattactccatttacagcttttcacattattttgatattatccgaaaatgttactgggcggatatcctcagtttctgcggggtcagcctgtcacagcttccggagctgctgccgccctgcagcattgcgggaacgctgcttcctgaactggcccatggcaatgcaggccttactcctgacacaaagattaacgtggggacgctggaccattttgccggaatgattggaaccggcaatatccaggaaggactggtcagcgagtcagcaggcaccgtgctttccattgcagccatggtccgcggccccctctttgacgacagccgtctgcccctgaactgcggtccctttcccgggacctacgtactgctgcctgtctgtgaaagcggcgggttcagcctggaatggtatcggaacacattcctgaaggacgtatcattttcccagataaaccagataattgagtcccggcctgacagggttcccccggtattcctgccgtatcttaccggcgtcaattcacctgattttaacgaaaatgcttccggcgtcttctttgggctccgcgcatcccatgaccagtatgaccttgccctggcaatcatggaaggggttgcctgtcttttaaaaaagaacctggattacatggcaaaatccggaatccctatcagcaaaatcatatccactggcggaggcgccaaatcctccctctggacccagattaagtccgacatcacagggcaggtaatcgaggttccggaaaatgaagaagccccctgtctgggagctgccatcatcggcgctgtttcggaaggcttctttccttcttatgaagatgcggtaagggaatgcatttccattaaaaagagatatgagccttcctgccatgaaaaatacaagaaaacatatgaagtgtttgaaaacgtgtatgatgcactggccggggcttaccggatggatgcggtcaggcgggagtcgggcaaaaaacattgaggaaccccagccttttacagccccatccctcaaaaaaccgcatccaatcatatccgtatgcggctaatatgggtggataagaaatgccggatatgggtggtcgtaatgatatcccagcttttctgccagcgcaacggattccaggttgtgcgcatcccagcttggataaatatttctctcaaggcattccaggattaatccggctccacatgcatatgccaggcccatgcgccgatattcctcccgggtatcgatttctatctcaatcccctccctataggttgcataggaggatgcgccggaaaccggctggtcgtcctttaatgccacgacccccagcccaagcctttcatacattccataatccgggtattgggaaaccaggtcccggctccaggcgtttaatctgcactggtcatataaatcctcatccatcatcctgatggtaaaaccaggcggaagggaggaaacagcccgccggagccttgacttatcaaatacatccggctcctttttgattgcatggcgggttatcctttcagccctggttccgtaacacgattcaatcagaccggaccagctgtcattttgaggtaccattatgacttcatcatggcagcagtccggcctgtacagaaccaattcgcggtttgggattcctgccaaaaagcagaaatcccccagagcagccattgcagacacgggatattccccattgtccgcatagatttcccccattatcccctggaggcaggaccagattatggtttcatcccaatggacaaaaagcggattggctttttgcgggatgtccagtctgataaccatgacacggcttcactccttcctttcacaggcccatttcctgcattgccccaacctgggcgccgggtcaaatccctcttccactcccatggttgacagcatttcacagggaaacccatcacattccccgcaatggttcaaccccttggattcacagcatgatttgacgccgcagacgcctccccagaaaggggcatccatattgatgcatcccctgcagttaacaacctgtttcctttcgcatgaatcacagcataccccgcatcttgactgaaacattatccattcctcttttctctttgtatttttgcttggaaatttctatttgtgtatgtttttccttacataataagagatgacatttttaagcaaaagtcccgggcggtccggattttattttaaaatcatgagtaggacggatcatacagcaatgcagctatcttctcaaaccattcctgtgagggtctctgctccggcagattacgataatagtaaagcattttcctgcctgtctcagggttgtggacatatcccttttcctgataatccagatacgctttcttttgcctgagtttttcctggaacgtattcctatccttcatgaattcaatccaggccgtgcattggcagggattgtggatatccatgaagctgcagtggtcattgaaaaatgattccaggttcatcctggcacggtacagcagtcccttgactgccttgggtgtcaaatcaaggatttgggctgtctcattgatggagatgccaaacatatcaatcaatgagaataccatcctctggttcaatgtcagtttccgcgtcattgcaaggaaacagccgtcccgcagcttggtaacttcctccgccacctggacttcatcaatgggcagcggcctggggtccaccaggaattccccatcatgttccagctcatccatactctctgcgtaccccatggtcccacgcttttcttttcttatcatcatacggaattcgttgatgcagatggtgcggagccatgattttatggcatcctcattctttaccgcagaaatgttggcccaggccttgatgaaggtttcctgggctaaatcctctgctctgtccgggttggctgagagtttgagggaaaggttgtagatataggaggcgtattgggtgatgattgattcgatggttagggaggtattgttgtccatttatggttccttttcattttgttggggagttttttgttttttggggaggtataaaggagggactgtggttgttcttttctacaatatataacttattctgaattattcatggaactataatcttcacgaaataattcaatttgtttgatttgaaccgacgaaaatctgatttagcaggaaaattctttgaaaaaagggtataaaatccctctaaatctaaaaatgcagcattttcgttttcaaggttcaaggatttttgttattccagctgtggctgtagcctgcttatgttttctaatgtttcgtagaattcatttttataagaacaactgctgcatagcttgaatatgatatatcttgctgaatgaacgacttttgctgctgccttcagcaatttcaatcgtatggtatctaccaattgcttacgcattgtctcgggtaataccaaacgtttaaaccagttaaaaatgttgtatgccagagcgtgtacctgcacgcggtttgcatttacgatttttgatgaactgctaacagctgtaaaatcaaatccatttttactttcttttatgaagttctccatggtgccgcgcttgcagtaaaactttattacctgttccggcgatgagtccatgttggttacgataaacgtatacaggtgtacggactgccctgttggctttttgactttacagacaatgcgccgtgggtattcccaggagccagcctgatacaggaactcaccataggaaactgcgtaagagacaagattgttttttgtgatttctgtcaggtgctcatccatatcagcagccattctccgaagagggttactctcttttaagcgtatggcataagagacaccatttgtctcgcactgcttataaaactctggttttgtaaatccgctgtctccacgtaagagcaacggaagactggaataatcattctgaaccccatccaacagtggctgtaaaaaatccactacaccggtggaagaataatccgtgccatcacgaagctggattttcaacaggtcaccggttattccatcataacagacaagtggatgataaccatggctctgatagtggaagttaaagccttcgccttcctggtggccataggtatcaagaaaggtggagtccagatccaacaggatgaatcctggttttttaatcgaatatacaatcttacgaaatcgacgcataaggtcataaaactggttcagcgtagattcatccatgcgattgaagaatctggataaagcgtttgacagtttcttttgttacaactttatatttggtattacagtccggacagtatcagtccgtgcctgccagcttgtactcgatcacttccgtggtctcaaaagcggaaaggtcttctccctttttgccggaccgtttcttccttttataggaggagggatggatttcctccatttccgactcctgcacgtttaagtctgcttcctgttcggcttcattgaagaggtttaactgggtataaccatccgcatatttttcgctggatgcgccaaactgtttccgctgcgcaagggtcagacggtcagaaagcatcgcgttcaggaattccagttcctttgttttttcctcaaggacctgggtcttggtttcctgtttctgataatgcgcctgcatggttttcatcaaggagatgatatcctccctgctcatcctgttcagttgttcctctgtgaaaagtggatccataacgcaacctcaacattctctaatctctaactgaaagtataccatagaaatgattccattcccataggaaactgcgttcgggagctgaggaaaatccgtgcataagaaaagaattttcggtttttgcgaattgacagaatccgggattatataacaatcttcgggtgacgccgttcaaaagcgccgttgggtttcaaggataatgattattccgggccgcaccgtaatattcagataacccgtcacacagccaatggatttcttttaacgtgactttctgtagttcatccggtgtgtccggccaatgaaaagaatcacggtccaggcgtttcatcagaatccaaaatcctgacccgtcccactggaggattttgattaatgtgcgcctgcgattgcatgtatattccgggcaaacgcgctcatgaatgaattggagcgcgcaagggtgaaagcagggtatcttgaatatgtcaaccagctggccggactcgacctgctgattatagacgactttggtcttatggagatggatctcgacaaatgccgaggcctgtttgaggtgattgacagccgggagtcacgaaagtcaaccatgtttgtatcccagcttcccgtaaaggcatggtatgggctatttgctgacagcacctatgcggatgcctgtcttgaccgtatggtacacaaggcgtaccgcctggagcttagcggccggaacatgaggaatccgaattcgtaaaaaccggcttacacttactatcgacaggacggtggcgtttcacgcaaatcggtacgaaacgccacgcagttcctgcgtgacggctacgccgttaaaccaaaatatgcattatccatgtcatcttcccttatatcgttaagaatactggtgattattccggggctctttgagccaactgtccggactttgagagccactgttccggagaatgggagtcgcaaattccggtaattcagagccactttgggctctattacatctagtgtaatgactagttgttattagtagtttagttatgtgaagtatcctttttatgaaagcacaattttaggataaagagacttcaaattgattcttgcatctgccgttgtaaactgccagtctactgtaccttttactttattccgtgtactttcccaggcgattagttctgaatacaaggtattgatatctggtatccggcgttttaaacactggcgtgtcatgacattgagttctatttctgctatatttagccagctcccatgctttggggtatagcggatatccagccgtttcgccagttccctggctttttctggcgggaatgccttataaagtgacgcacatgtgtgagtgtttaaattgtccataaccagtatgactttttcctggttcggataaatgacagttagtaaatattcaatttcccctgcccaatcaaccatggtacgggtctttcttacactggcgtggcgataatttgccagcggctgtgcaaagacaaagatactgcacgtccctttccgtttgtattcggcatcttctttccggatactgccgggcttaacggggagaggtttcaaaacctgattcaacagctggtacggcttttcatccatgcacacaacagggatttcctcattgtaaggaagtttataagtatccaggatttcttccatacaggctacgaactctgcgttttgctttggggggatgcaccagtattcgtttttgtgaggctgcagttcattttttttaatgcagagcgcacggtttctacggcaacaggctcaatgattttaagttcgacggctttatcccgcaagagctgcagggaccaggaggaatggccttgaggagctgcactacaggccagttggaccaggcgggcctgctgatccccctgtattttgcagacgttgttttgtctggggttgcggtgaatcgtagtacattcatcaaaccccaggtccacaaaacgttttaccgtacaatgtacggttgaaatagaaacatccagactttcagcaatctggcggtgggtaagatttttaccagaatctttgtgtagggcaagaaggatcagagcgcgcttctttatcgtaagtgttgtttcattcatggaaagtaatgctttcaaaaaagaaatctgctcatcattaaggaccacctcatatttttggttacgtttattatttgaacctgttcttgctatgtgtaataaccgcctttttctttaatgttatcacactaaagtatatttgacaactagatactacactagggcctgtttgaaaattaaaagttgcacaaaacatatgttttactgccctttttcatgttaaaataaaagaaaaaggggtgttcgttatgttgaagcgatatgaactgactgaccaggaatggaatcaaattactcctttattacctcctgaaaaatcgaaccggcctggccgtccttctaaggataaccgcacgatgctcaatgctatggtatggattgcacgcagtggcgctccctggcgggatctcccggagcgttacggcccttgggagacggtctatagccgattccgtaaatggattgaggatggctttctggacaatattttccatgtactcagtcttgaggccgaattagaggagcttagtatggacgcctccattgtaaaagcccatcagcatagtgccggagctaaaaaagggggccagcaaatctgattggccatagccggggcggggccagcacaaaaatccatgcaatcgtagatgcttatggatacccagtctatctacggttgagcgaggggcagaggaacgatatcaatatggcaatcccactgttggaacaaatcagcctgaatggtagccaggtcctggctgatagaggatatgacagtaatcagctgattgattataattatgaccacggtggggaacctaccataccctccagaaaaggtgcccggttcgagcgtcactgtgactggtggctttataaggaaagacatttagtagaatgttttttcctaaaactgaaggcctaccgaagaatcgcgacacgttatgataaactggccagtacctatctggggttcatatgcattgcttcaatcttaatttggttaaaatgactaaggatatataattttcaaacaggctctagggcagaagcaaaaccacatggcattactagaggtgccagatactatgcaggtaaaaaatcatgacaaatcaaagtacacttgataaacttattgaaatgcgtcttacttccatggcagatgcattccgtacccagatggatgacagcagcatgaaggaagttccgtttgaggaccgtttcggtatgctggtcgatgttgaatacagcagtcgcaagaataaccggctgaaaaggctgattcgttcagcagaactggaacagcccgatgcaagtatagcagcgattgactaccagtccggccgcaaactgaataaaacactgattggcagactggcaacctgtgaatacatcaccgaatgccgtaacatctttattaccggagcaaccggaagcggtaaaacctacatggcctgtgcctttggtatggaagcctgcaggcatttctattcggtaaaatatgtacgccttccggatttattactggacttacaggctgccagagataatggcacatttgctgccactctgaaaaaatacaccaagccagtactgctgattaccgatgaatggctgctgctgaaactcacagaagctgaagctaggaacctgtttgaactgattcataagagacggaaaaaatcctctacgattttttgctctcagttccgtgaaagtgagtggtatcagcagatctgtggtggtgaaagcacccttgcagacgccatcatggattgtatatcctacgattcatacaaaattgatattgaaagcattgatccgaccaaagatctctcgatgagggaagtatacggtctggatccggcacaatctaagtaacaaaacaggtggctccgttagtccggacaggtggctctcgccacactggactggcggctccgccgcaccgtaatattcaactggatagtaatttgtccgtccgcatatgagtctattatctcacatatgatgattttgaaaaggtacttactatttggcgtttacagagaaactatcggagcacatacgaaaacaaaaaaagcaggactcaacgggccgcgcataactatggccccataattgtcaaggtactggctattgagcatttacgtgccaaccttttgcactttctgataagacgcctaactcttcttttatttcatacctaatatctgccatttttatccccttctatatttttttaattttagccactaactcttttatatctattcgactgttaagcacctgttttcccaaaaagattttctctttatcacaggtcatgaagcatgactttacccaattattttctttcggtaagtcaatatagtaaagctgttcctttgaaatgttgtacaataatacactgtatggtaatttattgccatcaagatactcgaaaatatcacgttccattatgaaacttccatccttacattccagatacaacaagtgttttcttccacctaccttatatattctaaagccatcatcctcatctataattttacaatcaatctctgacataattttatcaatttccataaaatcatccttccttgtatgaactaagtgtgctatttatcaattcattctcatcatctgtaatatgtaaatattcacgtatataattattaaagttttcttgcgacattctttcaaaaatatgttctgtgtcttcaattaaaacaattggtaattccttcagaaatgcatttttatatattgagtatccatttgccttgggaaccgaaatttttttatagacatatgttaccacatcagaatttaaatacagtaacaaatatggataaaattgtttatattcctgtctcagctcagcaccacatgcactatctgtataaaaacatttttcaacaagtacaaaatcattaaacatatttatttctgcaaaaacaaattttttgttataaaaatgttctttttttcttgaattccacaattcaaaccattgtttagaactcttattaaaataatctctctgtgacaattcatctttcttttctaatagatagtcatacagattaggtgatgtctgtttaaaggtttcttctgagactgccactgtttttccattctctataacatatggataaaatacatatgtccctgtgtcaatcagctttccatttcgaatatcttttcctttatatgccggttccaaatataacagttcaagtgaattgtccgatatagtttcttgcgaaatcaaataaatattattaaatccagtaacaataccctgcgaaatggagagtgttacatctccaaatttttttgtcgaatattgtaaaagcttatttaatactgaattatcctctgccttttcaatattccaatttggttcctctaaatcactttgttcaatataatatgccgaactatcagacaaattttcttccaatatctttatttttgcgttttcacccatccccttctgggctccaaaaatacaagtgtatgttaatgcagtattaaatatttgataatccgaaaaatctgcaatatattttatacttgtgttctttaacagcaagtctctagtattcttaccatagtttcttttataaaagtatgatggacaaataaatgataccaatcccccttgcgtaagcaagcgaattcccttttcaataaaaagtacataaaaatcatattttccattcgctgtataataatggtctttatagtattccttatccggtacattatgaaaacctatgtatggtggatttccaataactacatcaaacccaccgttatctcggaatacttttgggaaatataattgccataacacaaacggtcttgatggttctaataagctttcataatactcttcaattaaaacaggatttccctgtatctgctccatgactatatcattatatattttttggatattttctttaatctcttctttgtcactatgctctttggtaaaaaatagcttatcctgcaattcaataagtttactaatcaacccatctactccactttgaaatacagaaagctgactattttctgatacattattcaaaagcacactttctgtaataagtttatttcccttaaattcatcaattaaactatttccacatatgatgttacaatccaaatttggtaactgtcttggtttggtatgtacgtcaaattctccgttgccagcttcatcagcgatttcatcatcaataactatcgacaaccataaccgaagtttcgcaatatcaattgcacttggttcgatatcacatgcaaagatacaatttttaattgtagtaactttcaggtcatatggttttctctcataagcataaaaactctttttctggaatccattcatctcaattgcaagatattctgtaagaacttcacgtgtctttactatctcgtttaacattcccagcggaaatgcaccagagccaacagccaaatctgcaaccctaacacacgagagcaaatcatccagttccttcaaacggtttaccttcttcttaaaactgaatatctcctcagatatcagcatatctttattcttgtctatttcataatgcatcttaccattatcatctgttatttttaatgtctttattgtatcctcatcacgcatgtattcgccatatagaatcaaatcacgcactgcctgttccgaaatacctgttttatttaccaaataattgataagtgcttcttgacacatataatgcacgatttcacgaggagtataaaatgccccttttgattttctgtcttttacatccagcagattctcaaacacttttccaagcatctctggatcgatagctacttctcgctccattggttcatcttcattcattgtaaaattatatctgtcaaaaatatccaaaatgccatctgcgtccctcgagcccttttcatctttattagaaaaaatatgattcgggatattgaaattattattttcccactcgtaattatcaagctgttcaaataatccaccattcagaaatggaatacgacgatgtaatggcggaaaaaatccattttcgccacgatttttattaagcccagtatagaataatggttcaagataatcatcaaaaaaattctttccagcagatttacatccttcaaaaatctttcgcataaagtcttttggtcctgttccccatggtttcccctttacaattcctgccaaaaattcttcatcctcatcggataattgtttcaatttatcaaatatgattttatatgtaccatctgtctgaaccgcatatacacggcttacaatattccttgatttttctccccttgcccaatatgccttattatattccttttctgtcatagttacaggaattgcatccactccaagccaaccttttttctgaataaaatagagaaatacaatctgtcccaataatttctttgcaaactgttcactggtaaaatttctgatttgagcctcttgcataaattcttcgttagattccagatattctctaagctcatggaatttctcgcaataaagctgaaaaaattcatttgtgaccttctctacgctaaatgcttcttcaatgtcatccagtccagaattatttttatcatcattaaatataggaaacaatctctgtttcgcagtattacatggctcgcccttacctacaagatatgaatatcttctggcaggtgtcagtttctccgtcacctcccctttcgagaattcataatccagacgaataaaagaaagtctccatttttctgattcttctagcataaagaaggcaaccaaagcacccgcacaattaccattttcaatcagcggttttataaagttcctctgcatagtccttgcacgttcaactgaatcgcccttttttagtgcaactgaaaatacagcaatcttttctccatcatcaccctgataattaccaatatgatagtatccatcaacataatacgaaaaattgttaaataccttcttatactgtgtcggtgctaccaacgtaacatcatttaaaaactctctgacaaagtcaatgaacaaatcgtgtttatacggatttgttaaaactgattcaaaaatatctgattttctactcattaatttctacccctttcatgtagcaggataagattacctgtttttcctctccatccacacgacttgccatctgttttcttccagcaaaatatttgtcatcgacctgagatacaattttatagtaagcttctacaccatcttcgatatttttaatactctttactatattttttgtatcattcgtcggcatatctccgttttcccagatttttatcatgcgtttaatattttcttcctgttcatctgtaaatgttttgatatttaacaaaccacgcaaatatcgaatcattttctggtcattcgctgcaacagcaggtcttgaagtcgtaatgacttcttcttttgtaaaagattcatcaaaagcctgattattataatcaaagtgttcaaagtatttatttcctacactgattcttggttcatctgattcacattttaagtacgataccgcatctataaatgatatctgctttgtatcataggattcagtcctatagaaagtctttagatatcccttctttataaatgtcatagttgcctcatctcgtactttttctgacattcttcctgttttggcttttcgtggcaatctttttattttatcaaacaaatcgatatcattatcacgaatatgtcttataatggccaagtaagctaattctgggttagcgctttcctcatctccatttaaatcagcattcaaatcttggaataacttctgcgaactaacctgctcctcatctgacaggtacttaaaatcctctcctaacgtatcatggaaagcctgtaacttttcaataatgcggtcttttaattgcaaatgcttgctgctctgagccgttggaaagaaattgaatacatatatttcatcaaattctgtacctacacgattaatacgcccaacacgctgcatgattctggtgggattccatggaaggtcataatttatcagggcatttgctctatgcaagttaataccttcagcaagaacgtctgttgttacaagcacatcatacttgtcattatccttttctctcatcttaggattaaagctgtcctcaatcgcagccttcaaaaccatactacttgcacccgtatatgcaattactctatcaccaaacaatgattcaagctctctttccagatattcagcagtttcctttgattcagtaaagataatctttttattacctttaagttttttattttttttcaaatcttctttaaactgattcaatttaggatccttggtaatcgtttcccacatctggctaagatatttcagctttgttaagtcccattttaaatttttaataaactggtcttgaaattcttccgacttaaaatgcataatagtctcatcctcaaccagcttcatcagcttattatcatcaccgctatctaaaaggtcgtaaacatccacctttttactgatatatacctccccttcatcatacatggcaatgaatttttcgtaagatgactgaaatcttcccagtgtattcttaaatgcgaagaaactactctctaaacgcttaaccaatatggatttcatgaaccctcccatattgtgctgcgaggttaatatagatgcaaatttcttagtgtctttaagataagttaatggcttgtatctagaatacttaaaattttttattacatcaatcgtctcactgaacatcatatttgtatcatcatcaaattcatatgcaatcggtataggatttcctaatttaggaaatgttaatccttgctttgcaaggtcatccacataatactgcaggatttcaccacgtgttctacgaatcataacatgacgaagaattttatctctgatttcctctgaatttgctctaagttgatttacatattgttgtgaaccctttgaaaatttgttttcttttctatgtagttctttaaaaaacgcttcaaggtcacgcaatccaataattgtactgtcatgttttggctggaataaatacaactgattctctatatcactggaatagttattgataggtgttgctgatatcaatactacttttttcccataacagattttatgcaagttactgaaactctctgttccttgatttctaaatctatgagcctcatcaataaaaatatacttgtacttatctacacctttatccaatatactctccaatttaccaagagattgtacctctgcagcaacatcaaactcctgcaatatttccttccagtagtcaactagaacaggaggacatatgatgagttttcttccttttggaaggcttttagctagcattgcacaaatatatgttttaccaagacctacgacatcggatacaaatactccattgtaagattccaatatctttcgtgcctgaacaacagcatctaactgatactgtaaacgcatatatccatctggcagtaaatcatcccctagcaattccttatctgcattgatttcttctttgaagaattcatataatgtctttagatatatttcatatggtgtaatgtcattgctcaaccatgtttttttctctacagtatcaatatactgttctgtaataggtactgatttttcccataattcttcaaattttccaagggcaaactgtacatcacgactatccttcaactctacattaaattccagattgttctgtaatccagcttccgaaaaattgcttgagcctgtaataacacttccgtatgtatcaggtgttttctccatattcttacgcataatatatacttttgcatggataggtgcctctacatatatacgcatctctagttttccactcttcaaccactccacgaagattcttaccccttgttcaatcgctgatgtagtatctgatttttcaaattcacttactatatcttcatcaaaagcttcttttgcctctttcgctgtcattttcgcaaaagcaacttcattatttgctttatcaataatcttaaccgtatatttatcaacattcagacctactaatattctgattttctctacatctgccatcgcttcacacattttgaagaatccgctggttctaaaatacccgactagaatatcaaaaaactgcgtattgctttgtaatattttactgaatctaccatataaatctctatcaggttcatttgtaaaaaatgtcaaatcgttatgcactgtattctctcctttgcaggtattctcggtattgtatatctaactcatctctttttgagacgaccatcttcgggcttcatagcatctgccagaatcaaccacatcttgccttttttaattactccatcaatacgaccttccgtacataaaactcctattcttctagaagaaacattccattttactgctatttctgtggtagctaaatattccattgcatagccctcctaatattttatattatattctactatcggaacaataacaactggaacctctatggtttttaatggtttctacagttttatctttttatttgattatcaagaatgtcacatatatgtatattgcagcaaggtttatgccccctcccccctgctgcttttgctactacaagaaaagcatttttctttccacaatccccctcacacacgcctgtatattattcattcttccaacccactccatagcattttcaacctttaactgctctgtcacaccttgcctgtcggcatattcctttaccagccgagaaaacatatcctcccgcctgctcgtcaatatcagcaagatagctgttcagtctaccacttgtaagcagcgtggtgtaaattgcccttttctgctcttgcagatagcgtttgtgacgctgcccccaaacactaataactttgttttctttttcggctggtagtgtaaggcaggggataagataatccccttcagactgtcgacaaagcccgaggctcacgcctcggatttttctttaaaagagctataaagcctcctgttatcgggattttatagctcttttctgatataatggaagtatcaaaggaaggtgggatatttctatgatgactcataataaggacaagaaaagaggacagatccagatgttctgtatggatgacctggttccccaggattatcttctacggattattgataaagcgattgactggaacttcatctatggccttgtagtggacaggtacagccctgataacggccgctccagcatgaatcctgtcatgttgataaaacttccattcatacagtacctgtatggcatcataagcatgcgtcagaccgtaaaggaaattgaagtgaacgtagcttatcgatggttccttggccttgaaatgatggataaggtccctcatttctcaacgttcggaaaaaactacacccgcccgttttaaggataccgacctctttgagcagatattttcccatatattgcaggaatgctataaattcaaactgatagacccaagtgaggtctttgtggattctacccatgttaaaagccagggcaaacaataaaaagatgcagaaacgcattgcccaggaggaggctttgttctttgagaatctgctgaagaaggaaatcaatgaagaccgtgaagcacatggtaaacgcccgctttaaaaaaaggatgatgacaatgacccgccatccggcggaaagggagaaaaaacaattaaagcaagtacttctgactctgaaagtggatggttccgcaaaggggaacataagagtgtatctgcctatgcagtacagaccgcatgtgataggaatggctggattcttgggtatagcgttcatccaggaaaccatcatgacagcaggacctttaagtccctgtatgacaggataaaggggattggggtaaagacactgatagccgatgcaggatataaaacccccagtatagcaaagcttctgattgatgatgggagcaagccgctcctgccctacaggcgtcccatgacaaaagaagggttcttcaagaagtatggatacgtttatgatgagtattacgattgctatatctgtccaaacaatcaggtactgtcctaccgtacaaccaaccgtgatggatatcgggaatataagagttgtggaagtgtctgcgtaagctgtccataccttacacaatgtacccaaagcagggaccatgtaaaggttgttgcacgccacatatgggagccatacatggaaatatgtgaggaaatccgtcatacacttgggatgaaagatttatatccgctaagaaaagaaaccattgaacgagtattcgcaagtgcaaaggagaatcatggattccggtatacacagatgtttggaacagcccgaatggaaatgaaaaccgggcttacatttgcctgcatgaatctaaaaaaactggcgaagttaaaggcaaaatggggactcctggaagaagggaatccactcaaaatttgagtttgtgaaagtttttctgtaattaaagatgtataaggtcttttatgataaaataaaaattataggaggcctttttattatggcaagagaaaagaaatctgtacacaaagtgtaaatgaccgatggaaagcgaaacatcatccggcagcttcttgaggagtatgagattgaatctgcccaggacattcgggatgcgctcaaaaatctactggacggtaccatcaaagagatgatggaatccgggatggacgagcaccttggctatcgcaagtcagaacgttccggttgtgatgactatcgcaatggctataaaaccaaacaggtgaatagcagctatggaagcatgaaagtcgaagtcccacaggaccgtaaccccacctttgagccacaggtggcaaagaaacgccagaaagatatttctgatatcgatcagaagatcatatctatgtacgccaaagggatgacaacacggcagatttcggaaacactggaggatatctactgcttcgaggcctccgaaggcttcatttcggatgtgacggataagcttctgccccagattgaagactggcagaaccgccccctttccgatgtctatccggtgctttatattggtgttagtatataagtatggacacgaaaagttgaacagcctataatagcaattgaaagagttaaggagatattcaacatggtgaagaatcaaaaacactacactccggaatccaaacagcaaatcgtgaatctgtacaatgccggaggaacctcgtttccacaaccagaatgtgaatatgacgtaaatcggagtactctcagcggctgggtaaagcatccctccccatcaaagtatcagagaacgagaccgttacaatcaaggagtacaaggctttgcagaaggagatgcagcgcctgaaaatcgaaaatgaaatattaaaaaaagtgaccaccatattcgcaaaagaacaataaccgagattgtgacttttatccagaataaccttgaatacgataccgtatcccagctttacagtgctttgaaattcccccggagtacctactacgaaactctggttcgtgtaccttcaaaacgccagcaggaatacaccgcattcagccagaaggtaaaacaggcatttgatgaatcgaagtatcggtatggagcagtggggatctgccgttccctaaatgattatgggactgcctgcaacctgaaacgcgtgcagcggcatatggcgatacagggactccgctctgttgtggtaaaaaagtacagccaccatgcgaataacggcaaggtgccggatgacagggaaaacatccttaagcgtaattttgaagcggcctccatcaaccagaaatggtgcacggacatcacccatattcatgtattaaaagaaggctggacgtatctggcctccgtgatggactcatgcagccgcaagattattggttatgcctatggaacttccatgactaccaatctggctgtagaagccataaagaatgcctgtctgaacgtaaaagccacaaaagggattatccttcatagcactcttggcagtcaagacacaagccaggcctttgaggattacctgtctggaaaaggaataatccattccttcagccgtaaagggaatccgtatgataatgcatgcattgaatccttccattcagtattgaagaaagaagaaatctatctgcatacataccaaaacttcaaggaagcccggagggcagtctttgaatacatagaatcctggtataacagaaagaggattcacagtgccattcattatatgacacctcagcagaaggaggatgaggaactaaaaaaggtggcataaaggcagctactcataaaacagtatcacaacaaactgaatatagggtagctgccatacagggtgcagaaagaccacatactgttttgatatgtggtctttttctggctctttgtcaatagttggggtgggatttgtaaaatcccgccccaattctatgaaaagggccctttttatgtttagttccaggttttactgattttgggcatgccaaataagcctccgcattaccgacctttttatcctatgatgtacagtgaagtatccgggttcggaaccgtttgaaattccggattccatagctactccgttttaatacctttatcttgttgttaaatccttctgtgggaccatttgtcaacccgtatttaaaggcattcaggatttcttttcgccaggccctgtaggtcttagcacaggcttcaaattccttgatcccacagctctgtgcattcgcaatccagtcatcaaattccttctgctgctgacgatacgcttccatctggcagatatcatagaaccactctttcatccggtgtgccagacgtagatcctcgctatagtgaagcattaaatcacaggcctgtttgttctcatccttcagctttttatagcgggtcagaatgagtttccggctgcgtttataatacttacgcagagaaaccggcatggaccgctgcagtcgtttgcgtacattttcaatcgcccatgtcacctgccggatgaaatgatatttatccacgatgattgtagcgtttggaaagaaggtctgtgcaagttcggtgtaggggcgccacatatcgcagacgaagaactttaccttcaggcgttctttcctgggaatgttccgccaataatcagccagatggctctgggtccgatccgggagaatgtcgaggatcctgcgctttttcggatcaaccagaatgcactgatatttaccggtagaagcattgcctttgaattcgtcaatggaaagcgcttgcggaagctggtcaggcggagaatagcaaatcgtgtccagaaggcggcagaccgtctggacggaaacaccggtaagctctgcaatctgttttaaggaaaaggtctgccggagcagggagacaatgtaaaatgccagcctgcgggtcctgcggtggtatctggggaggaacgaatagggttccgtgaaccgtttgcggcagtatgggcagaggtagcggcgtttgcgaaggagcaggataacttgttttcccagtaagggaatgtcctggacctcttgtaaacggtaatcatgaatccgttttgtattagccccacagcaggggcaagtctgttctaccggttgggactggatgaaaattttaatgaaagagtctgcctgaaccacttttttaataaaaacaccttccaagttaaggaaagccttggtataattagggtacatctataaggggtcacctccataacattaaactttggtcggaataatgggtttgggaggcttcttatagatgtattttattacaatcaaaagaatgttggaagtgtgcttttcagcacaccccaacattcagtatagaaccatttttctttgccttttgaatcaaaatctgatactatttagtaaaagaattttggcagacaaaggagcaagaatatggaaataggtaaaaatgatatacccaaatcactatgtgattatctgtccttgttgcaactaaaatatgattgtgaaacagtttgcagtttagtatcatctttacaaaaagatggcgtaaccgcatttggtataataccttacatttcgttgacaactatgtctgctttagaaattttggcatctgacaaggacttatttcaggaatctgacattctgcaaataaaggacgttcgtctaaagcttaaaatctttgaagatggatacggtaaatcaaagaaaatgttgttgaatattgattacttacaagaccaagtttttaaaaatatgcttaagtttgggtttatgaaaacttggaatattcatcagaatcttggaatatacactgacgcaaataaacgagtagtcggaaatacacaatacagttactatctattgcaggacaatcgtttattaaaaaagagtattgaaaaagttgctgacgcatattttacttcaccagataaatttaatttggacgagcaaacgggtagagattgctatgaatatgcctacaaatgtggacaaataattgggtctattcagtctggttttgaaaactttgacacaccagtgtcaatagccacaaaaaggagtactgtacaataccattatacagattacaacacaaatgtgaagtcctcactttttccgaggggagaggatgggaaagcaactacgctttatctattgcatattctatctacaataaattttcttctatacgttcttaactcttatgaaaatgatgattacggttggtggcttaaagttaattatattgcgtattactattccatacataaattgaaagatttacagcagcattttattcagaataagctaatgacacaagatatttcgaactattttgaagatctggacattgagaatgcaccctacataaatggaacatttagaaattgtgttatgcattccagactggttgacaaaaatgagattgccataattgccccagcatatttagataaaagtaagccgctttttggattagtcgaaacttgttttaatggtatggattatcagcagctaaaactgtcccttgtttcggaaactacaaaaatatcgaatgtattgtcacgttggttaggggtagagtctttacaagtaaaaccgttataattgtaaatagtatataacttaagtaaaatacactcgcttgttacgcaatagaatgccattttgaggggtataagtataaaacccttacctcccctcattatgcctttgcaaagccgcatgaatacaggatttttcaacccctattgcgtgacaaagaaaagctcaccccatgccttttgtaaaaaggctttcgcaatatctatttttcgatattgcgggtgtatcccaaaaaaatcaatactccctatttcattgttaaaagccattgcgccgatgataatagtttcatctttcataatcagcacctgttttttctgaatatatcgctttagctgctccaaatattcagcttcctttaggtatggaaaaccatcaacgacaagatagactaaatccatccaagccggaatatcggtttcctcagcaaaaataatatcggtttgccaatcaatatctgtgctgatttttgtgggctgattatgtcgaggtgcaatccaaaaccacctcattatcccaccgaaaacagccctcaccaaaagcctattttccctttccctcttacttctgatttttcagtacggattttccctctttccctctcccttttcagccaccgcaacggtggcctttcctgctctctgccactcacactcgcaatcaccaaccttatcaccataactctttttcgttcttcactttcattttttcttttaaaataaaggctttccgggtttccttttctcttttgggtctctttctttaagagggaaaagaggttggaaagatgcaggaaagtgaaaaaagttgagtggctgcttaatgtcggttaaaaaaagtgaaaccaaaagcatgaaaaaagcagagtcagcaggattgtaaaaatcctgctgactctgcgaaaagtcggattactttatgctattctgggccggatgattggttgggtgccggtgggaatgggatagatttgttcaagtgcaatcaaaatccgccctcttgtcccacccaaaatagcccattcttttcccggcttttttttcgggtttattatcatttttgaaatacagatgtgttttttctgccttcttctctgctctttttccggctttcatgcagccacatcatttgagactgtcacagccaaagaacaggaacaaaaacaggttgagttttgtttggattggttttgtatttgaattttccttgtaaatacgttgtttccgggtgttttccttttctatttttctttcctatttgctctttctctattttgaaaacagagagtgaacacagggcaaacggcagaaattggttggaaagaaaaggcggaaaacaaaaagcagaagtaccgggattgttagtcctgatacttctgcttgattttactttattctattttcgaccggaacattgagttaaagccggtgggatgggaacaagattattgttcaagtgcgattgaaaatcacccttttgtccagattaaaatagacttttttatttcagcattttagacgtttagatgtgtctgattctggttttttttctgtttcagttcctgttttcatcagcagatttgaccttagatacggatacagaatctaactgtaatactcataaaaccttgaaaatacattgtttttgacttgtttcagattttttcttccctttttcgcccttagtataattggatagaagagggacagatacagaaacagagccggcaggatcttaaatcctgtcggctctgccagtgtattactttattctattttcggttggacaacagacacggaaccggtgctatgggaacactacttgttcaggtgcgaatgaaaaccacccttttgtccagattaaaatagacttttttatttcagcattttagacgtttagatgtgtctgattctggttttgtttctgtttccgttcctgttttcagatacaacctttcccttagatacggatacagaatctatctgcaatactcataaaaccttgtagatacgttgtttttgacttgtttcagatttttttctttcctttttcgtccttcgtataattggatagagtagggacagatacagaaacagagccggcaggatcttaaaccctgtcggctctgcaagcttattactttattctattttcggttggacaacagacacggaaccggagggatgggaataaagtaatcaggattaattcaatctctgattatattatactatccctttattgggtcgtacagctgggaatctgcacaaaaatatatgtcttactggtatgacattctttcttcgttctgttataatttggggtgctatattgttttcattaacggtatcaatgcccggtgatttttaaacaaaaaaatagccagacggcccacataggctatctggctatcaatcatctatccgtttaagcggctttcatcaattcggtcatatcctctatggctgtcttgaaatcataccctgggatctctttgtacttcttcataattggcttaacgtactcacgttccgcaaagactctgacactgttttcgtttaagttctcaaaattcaatatgtgcggatataactctattttgaaataatttttgaattcctgtgggtcatctatatatcctaatatatcttcaatgctgaatttaattccatcaaatatatgttgaaatgcgtccgtatccacttccccttgtgtcattccacaacctgcaaattccgctgcgtcctctaccagatattttatcctgtttggattcaatgtcttatattcttttgctaaaaatctgcggttctcatcatcacttacatactgtaaaaatttgtctgcaacaaagttctgcatatcgttttctgctttcattaattcatcaattgtatattctttttttaacatattttgttaatctccttttcattttggtgttatgggctgccccttagcagacagcccggtaattgttccatctaattaaactgctacgtctgttccatatatatcttcccatgtaggaagttttggttcctccatatccttaaaccactcgtcatcctcatagcgtgcagggaatccaatcatcactttggaaaccagttccttttcctctggggtttttgccatctccaaaagtgtttcatcattcatgtggtgatactttccagatacccacatgaagatgtcgccctttgtggttttgaaatagcaatctttgtatgtactgcaataggctctgaaagcatttgacagcccgcatagagtgtcataatcataatcacagaaaaatgccttttcaaaccaggtacaaagctcattccacaatccttccaattccttggaactattatcactattataaacagcttcatattttgaaatatcaaaaccagcgtgtttataaatctctttcaacattttcaactgtgattttataaccttacgatcctgattaaaagctgccctgcgttcctttttagaaagcattgcttcatcataatccctcataaacttgacctcacgttttgaagtggcaaggcagtatggatcaagctctccctcaaatcttgctatcagctccgctaacttctggtacagttcaatgttctttctgtcatcctcattcttgaaaatatatacacacgcacaattcatgtaaaattctcctttttctgttcataatatttatttggtaatggggctgtggattcccgctcttgcttattctgtcaatatccttatctagttcctttggggttgcagctcctattcagttttcgattttatattgtttgatatttatgtaaacactcatgccagtatagaatatccacttcccggcagtttggagtggttcaatggagtttatctatctaacattttatcaagcggcaaactccgtttcccttgctgctttaatttgtttcaactgttcctgttcttgttttaatgcctgcaaataatcgctaagagaggtgatacatcctttttctccaaaataatatttacagttacacatagctgagtaatcattcttatcagcatatgcaccttgtatcgctttttccattctgttaacttctaagacagtaatctttgagttaaagtagaaccgatactttcggcagttatccggcgcactataattcttataatacgttggttctgattccatatggatgatattccgtttttgcagccgttccataatctggttaatgtgctcacaatcttcatatgtagcaaatcttatatccggtatacaaagtatatagttcatagattttctccttatttcatcaaagttttttgtgattcttaacgcctattccaccgttctcctttcttcccgcttgggaaatgagtgttttacgagttcgccgccatttattccttaaaccgccgggcgtagttccggtacagggcctttcggaccatcggtgttgcgactgattcagttttcaatgtgcaatttgggacacaaaaaggccaactccctataactacttaccttttaccttgtggttttttggtgttcgttataatgagttggccaactctttaaattaatttttcattccatctacatgatggacttatattctaccaccataccatttgcctgtcaacatattttttaaaaaatatgttgaattgaatacattttggaacattcaagcacaattacgccttttcccagcactcaatcttacatcatgtttttataggaattttcctagaaaaaacaaggagatgtaagatacatgaaacaatttacttttattgatttattctgcgggataggcggctttagacaagcactggaaagtgtgggaggtacttgtgttttttcctgtgataaaaacaaaaatacccggttgacctatcagtctaactatggcgatatgccagacggtgatataacaaaaattgaagcgaaagatattccaccatttaacatcctatgcgccggctttccctgtcagccgttttcaattgctggaaagcaacgagggtttgcagacgaacggggtactatgttttttgagattgccagaattattacgtatcataagccggaaattgtctttttagagaacgtggctaatctgacccgtcatgatggcggaaacaccctaaaggtcataacaggaactttaaagaagctgggctatcatgtaaagtgcgaggttctgaaggcaagtgattatggctgtgcgacaatccgcaaaagaatttactttgtatgtttccgtaaggatctgaaagcaaagttttctttccctgaatcttttgaaagtaatatcgctgttgaggattttttgaatcaggaagtggacgaacactattacatagataggccggatattgtcttttataaaccggatattacagagagagtacatgatacttaccggatgggctacataggcagcataggacagggacggaggatttacagtgtcaagggcctatcacctacttttgttgtttctgccagaggtccggcagggggaaccgaaagttattatatcaatggacgggtcaggagattaacaccggatgaatgcaaacgaatcatgggattcccggacaatttcatttttccggtgaaagaggaacgagcctatgagcagttggggaacagcgttgcagttcctgtcttgaaagcaatcgcaaagcagatcatggcaacagatgtgtttgaggacgtccaggacgagccaggtcaggtgatatgatggaaactgataaaatctactgcctggactgtttagagggcctaaaacagctcccggataaatccattgatttgattatgactgacccgccttatcttattaaaagcaccagggcaggaggacattcccggctaacccggtcaattcagcccgtcaataacttattaaaagaaaacagccttgacactggtatggacccggatgtactcccggagttagtgcgcgttatgaaacggattaattgttatatctggtgcaacaaggcacagataccggattatctggattactttgtgggggaactaggctgctccttcgacatactgatttggtggaaaacgaatcctccaccgacatgcaataacaaatacctatctgataaagagtactgtctttactttcgcaaggggggatattgccagcctacatcatacgggacagcaaaaacagtatttcatcagccaatcaatgttttggataagcagacatatccgcaccctacgattaagcctttaaacatcattaaaatgcttatcgaaaacagtacaagaccgggggatatagttcttgacccttttattggttcggggactacggctgtggcttgtatagagttagggcggcaatatataggctatgagattaatgaggggtatttcgaggttgcacagaaacggatacaggatacaatagaacgattagaggtataagggcagatagcccttttttgttgcttataaactggattgaaagcggatgtaaaatggaaatgcgcccccggtggagagggcgcaaatctttgatataaattactattgaatccatgcgccatctgcgcctactttgaatccatctggtgttatagtatcggaaagcatataaccgttgccattaaaataatagcatttatcgccaatccacttccattcattggcaggataggagccatcattattctgccaccaccagccgttggtatcctgtttccagccttcatttgcaatctgatccgaattttcattgattgaatccggattagcggttacataaaaagctacatcaggaatcatgctatcatcacctacaaagcaaacccattcttccggaaacgggacttgcccgtcccatggtgacgatgtatggttgctgcttaatctgtccatgatttctgccatatccaattcttgtgtcggataaacactaaaatcagccatgataccatcataggccagcagggaactgtccttgttataatcatttgtaatcggctgtccgctgtcacctgttaaagtgattttcgcatccatagtgactaccggtatcaccatactttgtcctgtatatggattgatccatgtagtcgttttaccggtattgccagaagtaacctgatatgtaagatttcctgcgaaagccgtaatactcatagcgattgttaatgcgactgctgttaaagctgtcctccactgttttttcatatttttgttcctccacttaaatttgaattttagtttagtttacaaattgaaactcctcagggatttcgccttgttctacagcgtcccaatataactgtgggagcatttcctttcctcctaacgaatatgtatcatcgttgtgattaagctggacacttccacttggaaaaattgaaaatactgtttttccatcctgccctgcgtaacgaagcggttcatgttctttgagatattcagctgtatacacaccaaaacacgctgctaaatcacggatataaaataaattcttctgttttataccatctaattctaagtatcgtggagaaaatccaaaattcttttcaccacctaaaacattactctgccatgcaaagaaattagctatatgtccatccccctttttataccatacgccgtgcgtatctgattgccagtctgctcccggctgttttcctctcgcccgttcatcccttaaatcagaaatgattgacttttcctgcctgtttctagttgataacggttctaattcccactccacatgtgcttcgatatcaaaataataatctctgccgtcgattctcacccattccaggcggcaatactctccattttcttttttataagcccttttgccattgtcgtcaaaccatccggccgccttgttttgatccaacgcgttggaatccacaacatagttgacctgttcattcgtattctgggagtgggcctcattatttgcttcctgtacccacgcaccgtccgcgcctaccttatacccatccggtgtgtctgtatcatgaagcatataaccgtcactgccaaaataatactgtttgccgccgatctctttccatgcattctgggggtaggaaccgtccgcgttctgataccaccatccgttcccatcctgttgccacccctcggttacaatctgcccctgtgtttctgcggtactctgtcctgactttgaaccgatagcaggaagctgactcatatcacaagtgtatgggtgggtggaagaatgatagattgcattaaatcctgaactgtcatttgcttctacgtcaataaaataaaatccgtcattgtattccaccatgttccactggtggctgggatttccggcagttgcatccgcatgaatataataacaggaaacatccatagaatcacagagggctttaaatgccctggcatatcctgaacaagcggcctgaccttttactaaagctccatatgcggtattagctccctctcccttgttccagtcaatataagatacattgtttaccaaaaaatcatgagcggcttttatcttctggtcgttatccatgttgtctgtaatgtaattcgtcttaaagtcagatacggattgagctactgcgtttaactgattctgattgagagaaggaccatatgcagagctggtcccggccgtgtaacttcccggattcttgttgattatatcctgtgccgtggcggcataggctgtcatactcattgctaaagctgtcaatccggcaatcactggaactaatattttctttctcatgatgtctgttctccttaataattatcctatttctccagtctttacgctagcagaatttgcataataaacatttgtctcaaaacctgtccttattgcgtcacttgcggcattttcatctatgacagaaatatttattataatatcattttccagacaaaatcttgacagttcatcggctgtcatattgtttccagtgaaatccaaagaatatgctttgtcatattcaagattataccgaatagggtcacctagaactgtaaaaggaaatgcctcttgaaacttttcattatctgctactgttcttgttgctccatatactaaaacataatgatcgaccggatttacatttgtttgcgaactaggaaatctaaatgtccccacctgcgtatctagtatagtgcaatttacgcctaaatgagtttcgggttcataaattggtaatccttcttcatcaaaccaaaaaccaatattcgccccttcttgagaagtacgatatattttatctggatatggattcgctggtttcatttgttcatggtatgcctcacagccgtcccacattccaaactcgtttgttttatatccgtctggtgcagttccatttattaaaagctgtccattggaatcataatagtaccaataaatccaatcagtatcagcacttttcttttgcacccactgattataaacaactgtcccatttactaaaatctgactatttctatatgtatgctctggatctacatatgtccatatttgtccataatcagcaaaatcaagacttatgctactttgcggaggtactacatcggcccatgctgttatactcatgctcacggccagtattccggctgttaaaagtgttaatagtttctttatcattctgtttcccctccctattcaatgttccaatatgaaaagtaaagattatcttcttctgcgttttcttccatatccccatattccgggcggatatagattgatttttcagaaccatcctgaatagtgattgtgtctttcccatcaaagctaatcacaaggttatctccgaaaccctctttgatttcagcaattaaattttgactatttcccaaatactggaatgtatatacccatctaaaatgatgaactcctgtttcttgatccactgtcagtcgataggttccgtccattacgttgttagtccaaaccggcataatacagatgcattttcccggcgcatcgccattatggagataatcataaacagtcccattctcgaagaatactccaacaatacttttttcttcgttggaatccagtataagcacttcccctgaatatgggtcaatgacttgtccgtttttatttatcggatttccgtaatgagtggtattgactaaaagccaaccgtctttgtcgaaataatatttttcagaaataccgtctccgtttccgtctatccattggctctcgtctttgggataactgccatcatcgttttgataccaccattgtccgttgctctgtttccattctccggcaaatactgtcatactcatggttgccgccatgattgctgcggatagtagtattgtgattgattttctcatgattaatctctccttcatatatgggatttctaagtatcagatattacatgcttcattactttctttcaacagagttgacatatttcaatgaatacaaacttaaagaatcatactggacctttacaacttcaccttcttgtaaatcatatggaaggtctggttggttggtagaacaatatgatacttctggatcattattcatttctccaatttgtattttgacattcttaattccgtccttttctttatagttgacccagcgtatcttgtcttcgacctctaatggctcataaggaactctcgtaatactatactcatttttagtaagtccatcttcccacgtaagagttactattgtgtacgtcttatcgtcatacttataataaattctatctcgctttcccgtaggatcatctttagattgtacggaagcctccgggtgtttacttaaaacatattcttcaatttgagttagataatccgaataataggctctttgggaataacaattatagctttctatcccttcaggctttttccctgttttctcatcaatcttatattcttttgtggaatactttacattataagaaaaatctggttcaggtttaggaaaatcattatccaatccaaacatttcaaaaatattattactataaggatcgacatcatttagctggattccaacatcattcaagtcaacactttcgttgctaactttcttcttatcttccccttttaactctgtctgtgcctccttgattgccgccttatcatctgcgcttagttccttctccagctctgcggcaagttcggctctctcatttttaggactactggaaccacctccgcaagctgtaattgccattgaaacagctaccatcattataccagtatagtatttctttttcatcttcttttcctcctgatttgtaaattgtttacttataagacgattctgtgactgaatcagttttatctttataaaatgtttttattgctatctctacatgattttctaaatcaaccttgtttctgaaaagatggattgtcaattcctcatgtacgccgtttaacctgtcgtgaaaagcccggatttcgttgaaaatattttccgtgtctgtatcttctgtgcattgtattacccagatgctgcactctgtatagtctccacctgtcattgagaaagcacgccagatacggaaacgttggcctaggtcaggctggatgcgctttggtgggctgtgtgatgctgaaagtgtgcatgataccagaatcattaccaatactatatatcgccgcttcattgttcttcataccatctttcaacccattagtaagctatacggatacccgattgctgattttatagtataccattaccttataaaaatcaaggagtttatgactgtatgaacgaaattaaaatccgctccgacaataggattagtgttggtgcaaatattaaacggatcaggcaggccaaaggtatccgggcctatgacctgatccgcgaattacagttgcaaggattggacattaacaagcagcggtattataagctggagcacgacctagctaacgtctttgcttctgaactggttgccatggcaaaatttcttgatgttgatatttccgaatttttcaagtaggaagttgctctggtacttcctgctttttttgtgcttctaatttctccaatagttcttttttatccctgtacaagttaagattttcattatttaagtcgctgttaagccatgtagcaatcataaccttgtagaataaaaacagtgttgatgtcaacaagacggctgacagattcaacaggattgagattattaggttgcggttatctttcatatccataaatacgttctccttcaagatgatttcaaatcaaatgttaaaacaagcacaggatcaccatcctcattatcaaccaaaatatgtacggctgacataatcgccatatacaaacaatgactttcacttgatatatccagcccaacaggattgcggagcgtggcttgtatgagagtttccctgtcccgttcaatgtcgaggattgatgaagtccgttctgcatatgttttaaggattgggagaattgcattgtcaaaccactccatctgttttatggtttcctctgtctctgtatcctgtttgattctttggattgcttcatgtactgcaatcatttctttgttagtcaacctgtccagttcttccgggacgctcccggccatatcagtattgactgtaaaatcatatcgttccataggcattttctccttaaaatatagtggcgccactctaattttactaccctaaagagactaaggacagccggaagaaccgctgaaaattccgattttggtctgtgcaatttgatatagatccatggaaagtgcctaatgtatatgggcgatatcatgatgaacgccgttgattgtgctgtacccggatagggccggggactgtccgctggataatgaaccagacaatttttaaaaaagccggaatctttcatttgagtaagtccgggcaaaaagaacattgacttttcaagagcctgtgcaacctatacaaagatgaaagacaggactatttttatatttgggaatagcatgtaaacaaagaagtttctcctataaatatattggttccgtataagagccgttgattttaacgaacctgttttttgtatacatcataaataggacaaaaatccgtgaacatctaccagaatcagacacatttcagaaaagcgcttattatctgattattgagaaaatgttttagaatctattgattatttgtttgggggcctgcccaaaggcaacggcttaaaaagagggttgtttttagcggatgcgggtgtaagaatagttgaattgctatcgccagcatgggattttgggagagaatttatagtttgctccagttttttcataaaggaatgaatgagttttaagaaaacagggggtgaattgacagctatggattttgtgcgtaaactcgttttttgagttttccacaatatccatggctgacaagaggggggtgttttcttggagcgtagcgagttcttatgcccccttttatatcctgaacatagaaaaagcgctaccattatagtaacgcttcagactaatttctatcatctattccgcttaatttgaatcaatcaatcccttcccgtagctgtttaaggaatccttaacttcgtcataaggtactattatatcaattgctccagcagcgtatggagcaatcgtagcttcctcgaacagaatgtggattccatcttctaagagcagccagtccttatcaaatgatatatttatactttctggatcagctgagattattccttcatggctgtcttttctggctttcaaagttcttttaacagatgctacaatgtcatcctttagctgtttgcctccaatatcactgatttttagtattcctttgtcaggagtaattgtataataggcatggatattatagttatgagtcgccttatcatgataaagtaaattatcgaaagtcaggctaatatatttttgcctggatatatcctcatcatttaaaataaaatcgtattcgacttcatttactttcatatcttctgtattcttttttatcacatcatcaatatacttggatatgatatcatttgtttttgaaacacattctctcttttgtaaataagaaacctcaggatagtataaactcccatctaagtttgttttttcttttggtctgatttttatccaatctggcaatgtccgttgctggatcacaccttttacagtccattgtccgtcaccattgatatctctcccatcaatccgtatattctcttgcattatttcatcttttatataatagcattcatatataccatctttatttccatcaatccatttccagccctctggctggattgaattgctgttcatatatctccatgtatatgtatcactttcttcattatcatgtttccaccaagtacctgcaaatgagttcattgtaaacataatgcttattccaactgttgcactcaatatcctgattaactttttcatacaagaagccctttctatttattcttacaaactctggcgaatttcaattctggccgtacatgctttcctgaagataattttaccatgggaacatatgtctttcaatgaaataatgaatgggtttgaagaaaaccacggatttcttatttacccttttatatcctgaacatagaaaaagcgctgccgttacagcaacgttatctcctgtgagatttagtatttttaattccggtattgtttatctccggcagttctggggcctgctccctggcctttgttagtattgatttctcaaatttatctgcaaaatgttcttttaacttaacctcggtgtggatatcataagtattccgcttcctactgattaaagcccggagttctgccatgttctccttgttttcctccaccaaagaataaaattccttataggtttgagcttggatttcttttagggtccgcatccgtttccttttctgttctacggattcagaagtagaaacagggacagacatttccggcttgtaagctgatttgatttcatccagacggttcatgacagcttttatcttcttctctgtgcttatgatttcagattctaactctttacgtttcttcatctgaatagggtttaaagtttcaagttcctgttgttttactgctaaagtctgttccaatgtttcaaggacttttaataattgttctgctcctttcgccatggctgcggcaactgcaagctgtgtctgggtctggtcctgctcactggcaagggtagccgacaacataatttgctgataggcggatgctatgtactgtgcccttaatccctctaacctggaggatagcttttccagttgttccgtctgttctttctccatggattcaatctgctgtttaaattgattgaggaaatagttgtcctccgcaatttcccggttgagatttcctaattctgtttgtacaccccgtttctctgcctgatgtgccgatgggccgagatgaacagacgcaactttattaattccctgtgattcgtaggatcggtggtcgatttgctcattgattccattctcttttaaagcatgattacacatactggcccaggattcacgccaacggtttaagctgtcttttgagttccaatctgctatgatgggattcggaacattcacggattttggctgtttgtcaacacgtttcaagtctttcttagcggcagaatcagaagtgagccagatttttttctttcctacatgataacgatattgctttgtccatccgtctgcttctgcctgtttaatctcggtgacagggattgatttttctatgttgtcttttcggcagagatagcttttttgatacttgggttcccattgaccatctttatcaagtggacgcatggtaagcatgatgtgtgcgtgcggattttgaaaaaccatttgttctggattatgggtaggatttccggcagaatcaagagggattccatgaccatctgtgacgggtggattgtgaattgcaacgtctgcacacatcccttgtgatgtgaaattttgttctatgtatgtccttactaggacggtttgttgttctaaggtgagttccctcggtaaagcaagttcgacctctcttgagagttgggaattaccggatttttctgcaagttcaacagagttccagagagtagaacggtctttgaaagattccggtgcattgtctggaagtaagatttctgtatgttcaatccaatatttacggctgtaatcatgtgtgatcccatcatattggtttgtgattgtatccccggaacgatagcaggcggctgctactgatgacctgccggtgctacgtcctattattttgactgacaaatggtaaattgccatgatgaatgtgtcaactcctttgtattgggttttgattatgtgcctttcggcactgttggttcttggtcttttgcttttagccccctgcaagggcttccagcggacgcacaccagtttagcgaagcgggctggtaataagtgcgccctttttattaaaaatagagcgggaatcaacgtcccaactctgatatgtagtctgcggttgcgggggaaagaatggcgaaatagataattttctggatatcagcattagtgaaagattcggcaggacagatttcattgattgcggcttcaaggattgctccacgctcgattagcctgtgggctctggctttccgttcctttaactttgcccgtttccgggcggcttcttctctgtgtttttgttgtagtgcttccagttccgtcatgtgttttatctcctgtgatgatgtggtttatgatcttgaattggctctgtaaaaccgattttttgtgattctgattttttcatccctatatctgtgttttgctttgcaagagacaatacttcttcccgcgtcattttcaaaaccgataaatcattattgtggattcgacatgtaaaaccatcaccatgatcccatacagccacgattgcatcattcaaaaatctttcatgtggaatatttcttaatgcttcttcatttatcacgtaatctattaattctgctctaagtgcagttctggctttctctttagatattttaaaatctggttctttttgataattattcatgatctacctcctgtgtctatgagtatcacctatacctgatatttttatcggttcatcagctatggataaagaaatatcaagattgttggtatttttgaggattgccctgtcaaggttctctatgacctcatgtgctgtcttttggatcgtctgcaaagaggatttcagttccggcaacgtcttatcgctgctccatcctgctaaatacccaaagctataatccgacgtatcaagtcctaaatgctggcacacaataaaagcggtactttcggcctccacctccatggtggcgctgtccctgatatgggcccggtctttatgtaaaatgctatgggctgtttcatgaaatgctgtcttaactgtctgcaaatcactcatgccggatttaatcacaatctccttattcattaaatcgtagtggcctttctttgagccttcccatgattcaaaatgaatcggcacaggagcaacctcacggatggaatccatcaacaccttgtaatctggtatctctccctttagttcctctgcgagttccggaagtggcctgccctctgtttgtgaaatgtcaaaaatggagactgcccgaaaactggcatattgaatctcttttacttccgtcatagggttgccatatgaatccctcttgacctggcctgtcttatcatccaatacctccaccgtttttttagtcttatagggacacggtgcaacaattgtaatccctttttcgcccttgcgaacatgacggtccagcgttccccatgtcttatatccggcaacataagaagcctctggtttttgtaaaagaattagcatggagttattaaagctgtagctgtgaaatttgttcatgacggaaagatactcacggtatcgatcagaggtgaaaacctctttaattcccgcctctaacttctccgtgagttctttaatcttatcgctttgtcctttcttctctgccatgattcacctctatattaactgctgttgtatctttcccaaaaacaagaggtactgtataatcaatgctccggcttggataggagaggagccgaatacaggttccatactgttcgattaaatctaattttttctgcaagttcattatcttcccctcctatgtgtgattgtatcagctatgttatgttcttgtgttaatccgactcctgccagttttaagctgtggccgtcaaactcataaacattatcggatagcctatcctggggcggaacttctgcttcgttgattgatgataccatctgtcttaaaccctcaacatcgtccagttctgattttggaataatcaaaacttcatggactgaagatggaaggatataaaaatcttcacctatctgcttctggacttcctttaggacttctggacatgcaatgacggctgctccatcaatcccgctttcatttgttaatacctggaatggtgctgaacgaaactccattgtcatagcctccgcaagctctttatccatgccctcgtctgtcaacatccctgccatgataacgtccattccctcgaatcttgcacttttggccgtgttggactttgcgatttttaaggtttcctctttggtgagctgtaagtgggctagaagctgatccgtgacttttgcagttgccctcacgccggagctgacatctccaaaatcccatttagcaaagacggccagatcggatatccgttcatgaggaacttcttttaaccaatctttgttatcatcatagctaacaatggcggcctgtaaatgcgtgatggcagaattgcggttcatgccatgaatattaaactttgacagttccggtgcagtccccatgagttcagttcttatgccagatacaatatcacccatggagtttccctgtctccaatcgtcataataaaaatccgggtatacggttggtgccatagaaacatcgggaaattgaactgtgatccctttcatcatgacattgtttttcggtatggttacctcatgcagttgtccaccgcttggctccatggccttttccagtgccgaataaaattcattgtaaaattgttgtttatcgttcattttgttttacctcgtttgatttattgttatgggccttgacctcatcggccagggcttttaatttttcgtctctgaaatatggacattttatggtcctaagttatccgattccacctaaaacaagaatctcttcaccttttcctgccaactttattaaatcgttcgcatccacaatcggtttgtcctcatatgtatagcttttgtgtctgttttttccgccattcaaagtttcttttttatccctatatgttccgcaccaatcggaaatagccttctgtgttttcggatcgttacattcaagtatgactttgacacggcagttatccatcagaatccttgctccatcatctccataaatctgctctgcctgtgcaagtgattgaaacgcaagcagaaccatcacattacggcttctaagtgtataaagggcattgaaaacacctttgatttctccgattctggcaaactcatctataattagcaggataggcttcttttgttccttaggccgtcgctccaactctttgaatacctggaccgtgcaaaggcgcatgatagctttataagtttccagcatatcttctttaattgacaggaatacggattttccctccaacagactgtacggactggctttctgataattatccctgaagcaaaatcgtactgaatctttgctgaatacgctcaatgaagtacacatttccgtgaaaatatcctgtacgctttctgcagttttgccgttgaatttggctaaatacttataccaaaggtctgatggttcactgtctttgataatttccgttataagtgaagccgtatctgattccaatattctattgactgaatcaatgaatgactctccacgcatatagtaataaaccaacaatccagtcaaagcagtttttgcattttccacaaagaaaaaatcttttgaatttgtgcttacaatcaaaccttcgctaatttcttcaatggccgcaagaatcaggtcattactcggatgattatgaaggcggtaataaacatcccagccacaggaatctctattttctggatcaactacgattacatccgggttgaacatgggagagcttacctcatgcaattccccttttatatcaatgctgaaagaagtaaatccattttttccaccagcaaaatttgcaagtaatgaattcaggagcacacccgaacttttacctacacctgtaccacccaaaatgcaatagtgataaatgtcttttagcggcacccgaacatattgatttttatacttgcctaaaatgattccttcaggttcttttgatagcagtttcggcggcactttgggatacatagcaatccgtttctgtggcgattctttttttaatccggtttccggcacaagtccatcaccgatatgtatttcatcaagttgctttccctcgcaagcaacgatccagaaattgttaaaagaagtccatgcaattaaaaccagattaattatcataatctgcctggaagatatgccaggaatgatatgtggaagaaacaggcatagaaacgggggcagatacaggcccgtaaaggccaggatactataaagccgtttcaacagcttgctcatgctctaattcctcccagtcaatttctgccataactttatacttgtagtaccagtcaagtttgtatctgatttcgtccatttcaatttctgatactatgtaatagttgcctatttttttcatagtgaatgtcctccctatgtgctttgatttacgttcccttacacttaatattatgacagtttgggtcggtaaaaatggcttagttagagggtttctacccttatgtactactatttttttgaaaaagaaaaagacgctctgggcgtccttaacctccaaaaataaaatcctcaacttctatctttctgattgcgttggcttcctcctccgcataactgcatagctccgcaatcgcttcatggtattttattcccataaagtcaatcaaaaactggattgcgtcattgcaataaccgggttccccgcgcttgtgtttctcatgatcacaatagtaataaacaccgttctttcctctgtaaaaagttatgtatgtctgtttggcataggcatattgtcctggtgatttctcaacgattaaatcaggatgatattttaacagataccggattaagtttgtatgtctggctatttccttagattcgtttgatatgttgttttgcattaataagatcccctttcatatggtctaatattaatatgacagattcaaagcgaatggtgctacttgaataaaaatattttcttgaatcttctaatcctataaatggacagagttatcccctttaaaggatattggtattttgtaatacatagagcttacgcattatcttattctttactccatagcatagaactttacatatcatagagtttacacagtccttagagcttacgcacactaagggtttacacagtccttagtgtttcacaccttagagctaccgcacagccacacactggttttttggaaaccaatgtgtggagctcgacgaaaagaaaaattagggggagtggtaatttctgtgagcagctatacttttctttttcgcccagctacaacagggaacaaaattttttgtttcctgttgctgtgtgctacgcactctatgtgtgtgaaactctatgattggaattgcttaaaacaattcctctatgatgtggaactctatgcttgatattcctctatataaggaatatccctatgattggaattgtatcaaacaattcctctatgatgtgaaactctatgcatatatacataatagatatataacgtaagctttactgaaaacagaaatgtccttagccaacttaatgacaaaggtacatgataaatagttcaaatgaaagcggcgttatcctgtcctaccgcatgagcattactgctcctaccaatcatgtcctatcccatacgcaaccaatatagaatccagaaccgaacctaaccattcacttttaatcccataaatcccatctgttatcaatttatgtccgcttttcagcatgtcggtacagggcatagttgtacctagacagtggttgtgaatctttaccacatgacacgggccggtatcatgtaagcatccactatgcaggatggtctgtcttacactggccggctggccgggggctggcttgttttaacggtgcccaaccgcaaattacattttatactggcacgggacccagatagccatatacactaggttgcctattatgtatatgacacttccatgatgccgcatggacacacctgactgttttcatctgcctattagtaatccgtccgtcagcaatcggattacggctattcaattgtttgctactgccaaagtttcaaaatgcagtacacctttcagacaaggtttataagtctagtatgcaagattcaagcagggttgacggtaattccataccgtttatttattaattttttatgaacaaagttaaggtcagtttataaaatgtttagatttgatttcggctctattcgctctgaatctgtcatattaactgtgtaggcagtttgactttcttttcacgccaacagcttacatcaaatactcaaaactatttaaccaagcaataaaaaacacaccaaatttcgattgaaaggggacaggcaatgcttttatcagacagcactataaaagcggcaaaagaagctaatttaattgattacatgcttacatatcatcctgactgtgttatggactattacggtatccgggatataagccacgatagtctggttctgtatcctgattcattctgtcgttattccaccggggaagtcaaggacagcatttactatctggtgcattatcaaggctatgaatggagggacgctgtcctaaaactcaaaaagttttcagaatctcatcctgatgaatccccaatggcccgttgcttctctggtaagaaaaaggaatcccatttctacaagcctatacagacgaaccatattaattcaatccgtgaatacctccactatgaacggggaatctcactccccaccatagatacgctgattcagcagaagaaaatctatgccgcaactgcccccggttatggggctgattatgtctgcttttcaaactcacatatgggtttttactccctccgcaacatatcaggtgagggtatgcctaaactgctgttcacaaagaaaccagggggattctggtggttcacaacagaaaagccttggcaaccggataatctaattgagcggctggcctgccctatgcctgtttactctatggatacacctatctatgtatttgaagcacccatagacgcaatcagtttttatgaactttacgaggaaccgggaatctatactgccatgggtggactaaaggatacagctcttgataaaatccttaacgctttccccatttacaaagaggatcacaggctctaccttgacaggcaagtgatacttgcggttgacagggacggagccggggacagattttcagagaaacacaatcaatttgagcggattaaaccaacaggaaaagactggaacgaggatttaacttcttccgcataaagaaaaaggatgggctgctgataccgatagtccatccttttccatgtttatatattaacttgctgttatcccgtccgtcctgtctttcatttcatccacacaatagcgaatgaatccagacgcacttgaaaaaccatattgattcacgcacccattaatataatcccattcactctttgtaaggttcaatgccagtttataacttttgggattctctgtctttggcttttgctcccagaatggctttatccctaagttatgggaaatgttatccagatgtgtttcttttactcccagattttccgcaacaaactttttggaacggattatttttgatttactcatttctataaactgcctatccgtgttgttctggattcttgtatggctgaatgttgtttccggctcctgatttaggaacattgatagaattgcatactgttccggtgattttttctgccaccgccgaatctggccgattaaagcggctcctaatactatactcccaaaatgatgggaaataaattcttcaccgtacctatcacataaattcatggataaccgtttatagtctacactgtaatacatatcctttctggcaagtccatatccggcatttagtaatccctcatatagattgttatatccatctgtcggtcctgcttctaacggcattttcaaatatcttgtgagcatttttgtaaattccagttccgtttctgatacctgataatccgcactgtccgtatctttgtattccggcaggataaagttattgttcagttcattcttgtattccctttggcgggttatcaaataacatttatgtttctgacagactgacacatatggtatctggtggcttaaatgccaatatgtctctccatgcttcttaaaatcttcctgcatacagagagggcaggatttcagttccattgattcatacggcttggatattttcactggaaaattaatctttccatgcttcgtcatttcaagaatattattcttattctccaaaggctggaaacggaagatatatttaaaaagtgtgtggtttaaggcaatatcttcaatatccaacgtcccatccgggagctgccctgcaatatcaaaaatcagattatttggcaggaaactacctaaagcggcatgatccttacctccaaacaattcacggaatgttgcggcactggttgtatttcctgttcttatatgatacctgcataacacgctgtaccaaagttcatccgggtatggtgtgggaaaatactgcaacattaaaagcacctccgttctatcatctgataggtttccaaaatcttaaagaaattctctgcggattcatcctgcttccagattgacagcaggtcgtctttatccctgtccgtctgctttctcccacgctgggtagcgtaaaaccgctttacgggctttgtagtggcttctgttggcacttctggttcttcctgtgtctgtatgataatttcttgtactggcttcggttcggaaactactggaagtgtaattacttttgattcgtctactacactgcactcaacctcaatctctgatccgtcaacttcatcgacaccgattgtctcaaactcaatctcctgtacggcaaaatcagaaatagatgttccaccacgggcatatactttcggcacctcaatccctaagtaagacactgcctgtttaatggattcataggtgattttctccttaccggataaaatggcttgtgtctgtgcttcttgaaatatcttcacgatataggcagggattccggctgacagatcgtaaatctgtttcatcagtttttcgctcaattccgctttttgtaatgtcatttgatattcccatagggtagaaataaacttccggtaaatcacatcatatttcattggcaacaatctcaaacctctggtacgtctctttaagtgttcctgcttcataaataaatcttcggcttccagtgttccacagaaacagattccggtactcgtttcgttggtaagttccacaagaaatttaatcaagggtcttgtctgcttattttttgcggcggtctggattgcgttctgtatctcgtcaatgacaatcaatccaatatggtgattcatgcaaataattttcaacctcgttgtcaatgcgctggatgatatgctctttaagctccctgcctgggtgaaatattccgaaccgattgcccggtcaatggcagacaggatgttaaaagctagagttttcacactacaatcagagggacattccactacgagatagttaatctgtttcgtataaaattgtttctccttatacttcgtgtggattatcacttgcggcatggtactcaagcacctttggattgttgatgttttaccaattcccggcactcccaaaactgctccgctgtatgcctgggtcgagtagtttaatgtacgttctctccctgtgcgaaaatccatataaatttcgtttaactgccttacggattcaatcactgtctttgtctggtaagtagttgccatggctctgtaaagcatatcgtagagagtatacatataatccataggctgaaaccatgttgtcagttccgtcaaataatttctccgttcctgtggacttttctcttgaatgtcatacggaaactgtatctcacttttcatgcgttccgtaaattccgctttccctaataactccggcagggcttccaaaaaaagattgccctgctctttgtcatattcggctgcgactgtgtttgtatgctcgtttctatatttcatcatgccaactccctcctgcgattctgctgaatctctgttccatcaattttacccttatcaatgcactcggcttcacctacaatagattggatactttgcaataccttgatccgtccctctgtgtccagacgttccaactctttgctattagctctatgcttatctttctccatctgatactcggtctgtgtagctccgatatactgtttacaatagcttgcaagttcaaaaggtatgtactccataccctcaatcaggtatacacggctcacattattcggatcgtatgcaatctgtattgtatcgcccacttttttatattccatgagcttcttgaactgcgctcctgtataccaaagcccgttgttactgattcccttgcgggagagggtagctgctttccttggaagtccaaactggtaaagctgttctctggatactggaattatcatggacttgttttcatcctcataccagttccataatccggcggctgtgggcgttgcttctcccacctggctattctggatgatccggcagctattaagatacaaaacacaatgaatcactacctttgtaaaatcttccagtgtcaacacggcctggctcctataatctaccgcccaccgttcctgtgcgtctgcttcgattactcccttacctcgtagggccggtttgtatttctgttgcataaggtcaaaggacttctccacaaggcttttcccatccggcctgaatggcggcagggattcaaactcaatcccgtacttcatggcaagttcttccatacgacttccgataaactcttttcccttatctgtgatgatctcacccggcaggcccgtgttgggccattcttcctgtgttatctcaattccgtattgtccgcaaaactcaactttatccatggctgcatttgcaagacaatttatcaccgcctgttctcctgcgtctaagcctacataaattccggctattaactgtgttgcagtatccactgccatatagatgtttggacgtccaatcacggctgatttatctaacctggacacaaggtgtatatctgcctgtgttgcgtccatctgatacgctccaattttatccctccaactcatagcacttccaaaaagaggacgtttgtttctctggtagtctgtcaatccgtttctggcaattgtgtttctggattttgcatgataaccgccctcgtagaagtaatggcggaaacagtgccaacttggacgagtttctaataagcgtccatctgcatccgcgtatttggaaagcaacatcatgtcataagcacttcttagggacattttctttgcggaataataaaaggtgtcaatcgcccaacggaagtttttctgttcctgcgtctccggcttctctggaagtttccgttcctctaccagcgaccgccctgccaactgacgaaaatatagtttttgaatcctcttgactgtgctcccctcacgctctgccagttccttaattttccggttccgtatctgtttgtccatgatgtaaagttcatcttccataagttcagctataagttcaagacgttttctctgtccctctgttggattcttttgcctgtcaatatattttaagtattcctgtggcggttctattctgggatataatttcaaatcctgttctgatacaaaatatgggctgcatggattctcataagatataatccatgctccgctttctgcctttaacacaatcctgtaaacctctcctgatatatcaatgaacatagatttattcccctttctccataatgatgattttccaatcccggacagattcagatacggaccagtaccgtctggaaaattccaacttctcaatagtggctctctttgctaacgtagcttctgtggcaacctcccggatacctatgcttccatcttcaaagtgaagaacaaagtccgtggcccactctacgtcaaaatagtctttgcgaatatcaaccggatttataaactgatacctctccatgtccaacgcctgacaggtttcataagaaacaacctccggctcctgttccaatatccttgcatactctctagcctccctactgtggacacataccacctttttgtttttatcactgcgaaaacttatgtccctacgttttacccctgctttgtccattcaactcactccttatcaaaattagatttagtcagcgaatgaattaatcccaattttaaaaaccccatccccaaaaccaaaaactccaattaattccgaattaatcttaatttttgtagccaaattctccaattaattcatagagccagtcgaattaatcctagtttttgtagccaaattcttggattaattcaatatcaaccgaattattccgagtttttgtagccaaattctccgattaattcaaaatccggagccaaaaactccgattaattccaattaattagaattactttgttcaggtgcgaatgaaaaccacccttttgtccagattaaaatagacttttttatttcagcattttagacgtttagatgtgtctgattctggttttgtttctgtttccgttcctgttttcagatacaacctttcccttagatacggatacagaatctaactgcaatactcataaaaccttgtagatacgttgtttttgacttgtttcagatttttttctttcctttttcgtccttcgtataattggatagagtagggacagatacagaaacagagccggcaggatcttaaatcctgtcggctctgcaagcttattactttattctattttcggttggacaacagacacggaaccggagggatgggaacacaactattcaaactcaatcgtagccggcggcttccccgtgcaatcatacagcacccggttaacccccttcacctcattcacaatcctgctggtcaccttccccagtacctcccagggaatctgcgcagcctccgcggtcatgaaatcagatgtaagcacggccctcagtgcaaccgcataatcatacgtcctctcatcacccatgcatcccacggagcgcatattggtaatggctgcaaagtactgccccaggtccttatccaccccggcctttgcaatctcttccctgtaaatcgcatccgcatcctgtacaatccttaccttatcagccgttacctcgccgatgatcctgacgccaaggcccggacccgggaatggctgcctgaataccagatattccggaatccccagttccaaaccagccttacgcacctcatccttaaacagcagacggagaggctccaccagttccttaaagtcaacgtgctcaggaagcccgcccacattgtggtgggatttgatgacagcggacttgccgaggcctgactcaatcacatccgggtagatggttccctgaaccagataatccaccgcgccaatcttctttgcctcttcttcgaatacacggatgaattcctcgcctatgatcttgcgctttgcctctggctcttccacgcccttcagccttgcatagaacctctcctgggcattcacacggataaagttcaagtcatactgtcctttggggccgaatacggcttctacctcgtccccctcattcttcctcaaaaggccatggtcaacgaacacgcaggtcagctgcttaccgattgccttggacagcatgaccgcagcaaccgaggaatccactccgccggaaagcgcgcacagcaccttcccgtcgccaatcttctccctcagcgccttaatcgtggtatctacgaatgaatccatcttccagtccccggaacaaccgcagacattgtagacaaagttggacagcatcctggttccctcttttgtatggactacctcaggatggaactgaaccccatagaaattcctttccgcacactccatacccgcaaccgggcatgattccgtatgggctgtaatcctgaatccggcaggcacctgggcgatatagaccccatggctcatccagcacacggtcttgggcgatactccctcaaacagcttgctggatgtatccacatccacctccgtgtgtccatactcgctgacaaccgctttcttgacaacgccctccagcagataactcatcagctgggctccataacagattccaagaaccggtatccccagttcaaatatctccctggaacagcgcggagcgccgtcttcaaataccacatccggtccgcctgtgaaaatgattcccttgggattcatctccttaatcctgtccaggctcatattgtaaggatggacttcacagtatacattgcactcgcggacgcggcgcgcaatcagctgattatactgaccgccaaagtccaaaacgataatcatctctctatccatgagatttcttcctccatgtcatgtcttttctggatattcccgccaaaacctaaaatccaaactacctctccctataccatgacccaatttatcagaaaatatttatatccgcataaattgaaagagattgtacaaaatagtacaatctcttttttatctttcgtatgaatatattatacggcaccctgccgcaaatagcaagtaatttcgacaattttctcagacttttttctacccccattttccatgtggtttttccggcttcaactccaatccgcccaagcccgcgccatcatcctgtctatgaatccatccctgcctcatgctgtctgtccatgtccaggtatttcttaatatagattccggtataggaagcaggattcgcggccacgtcctccggcgttcccttggcaatcacggtaccgcccttgtcaccgccttcgggtccgatgtcaatgatataatcagccgtcttaatcacatccagattatgctcaatgaccaccaccgtattaccgccgtcagacagcctgcggaggatatcaatcagcttgtgcacgtctgcaaaatgcagccccgtggtaggctcgtccaggatatagatggtcttgcccgtgccgcgcttggacagttcggttgccagcttgatacgctgggcctcaccgcctgacagctccgtggaaggctggcccagcctgatgtaacccaggcccacatcatacagggtctgtatcttcctggtgacagatgggacattctcaaagaacttaagcgcctcctccaccgtcatatccagcacgtcataaatgctcttgcccttgtacttcacatccaatgtctcacggttataccgtttgccgccgcagacctcacatggcacatatacatcaggaaggaaatgcatctcaatcttgatgattccgtcgccgctgcaggtctcgcaccgcccgcccttgacgttaaagctgaaccgtcccttggtatatccctttgcctttgcatccactgtggatgcgaacagatcacggattaaatcaaacacgcctgtataggtggccggattagaccttggcgtacgtccgatgggggactggtctatggcaatgatcttatccagctgttccgtgccgtctattcccttgtgcctgccgggtatggtccttgcacggttcagtttcctggccagggacttgtacaggatttcattgaccagtgaactcttgccggaaccggatactcctgtgacacaggtcatgacgcccagtgggaaatccacattgatgttcttcaggttattctcagcagccccccgtaccgtaatccagcccgtgggcttcctgcgctcagccggcacaggtatcctaagcctgccgcttaaatacgcccctgtcacagaatcctggttatccatgatttcctgggccgtacccatggcaattacctgtccgccatgttcgcctgccccaggaccgatgtccacgatacagtccgctgccagcatggtatcctcgtcgtgttccaccaccagcacgctgttgcccaggtcccgcagatgaatcagggtctttaaaagcttgtcattatccctctgatgaaggccgatgcttggctcgtccaggatataggcaacgcccaccaggcccgaaccgatctgggtcgccagacggatccgctgtgcctccccgcctgacagggttccggttgccctggaaagggacagataatccagccccacgtcaataaggaaacagattctggcccgtatctccttgaggatggacgccccaatggccagctgcatattggtaagcttcaatccatccaggaaatccttgaacttcacaatggacatattggtggcctggaagatattcatatcccccaccgtaactgccagtgactccttcttaagcctctgccccttacacgcaggacagggggtaatccgcatataggtttcgtactctgccttggatgcctcggaaaatgtctccttataacgccggttcacattctcaaccaggccctcaaaagccacgtcatacacgccctcgcccctctggctcttatagcgtaccttgacttccttcccccccgtaccgtacagaatcacgtcctggatttcctttggatagtcctggaaaggagtgtccagacggaacttatattccttggaaagcgcctcgaggattgcccttgtaaagcttcccttgtccgtacaggactgccatcccagcaccacaatggcgccgtcatcaatggaaagggacttgtcgggaatcatcaggtcctcgtcaaactccatcttatatccaagtccgaaacactccggacacgcgccgaaggggttgttaaaggaaaagcttctgggctccacctcatccacgctgataccgcagtccgggcaggaaaagctctggctgaagttcaccggttccccgtccgtcacatccacggtcataagcccgccgctgagggccatcacggtctcaatggaatccgtaagacgcttttcaatgccttccttcacgatcagacggtccactaccacttctatgttatgcttgatattcttatccagcctgatatcttccgaaagctcataaaggttcccgtcaatgcgcaccctcacataaccgctcttgcgcgcctggtccagaaccttcacatgctcgcccttacgccccctgacaacaggagccagaagctggattttggtacgttccggcatctgcatgatatggtccaccatctggtcaatggactgcttgtgtatctccttgccgcacttgggacagtgtggaatacccaccctggcatacagaagcctcatgtaatcataaatctcggtcacggtacccaccgtggaacgcgggttccggttcgtggacttctggtctatggaaatggccggcgacagcccttctatgctctccacatccggcttctccatctgtcccaggaactggcgggcataggaagacagggactccatataacgcctctgcccttccgcatagatggtatcaaaagccagtgatgacttaccggacccggacagtccggtcagcaccaccagctcgtttctcggtatatccacggatatattcttcagattatgctcattggccccgcggattttaatgtactgctttgccattcaaaatgctccttgtctcttatcagtaatctttacttaaaactctccccaaagtgtatggcgtaagtatatcacattccaccgtcatttgcaaacatttgttcgatgaaatgctgtaggattgctggaacttcttccagcaggctccttgcattgacacgttccgacatctgatgcgcatccctgcccacggggccgaacagaagggccggaacctggaaaacagacatggcgtccaggttcattccatacagcttcccccacagaggggcattggccgcataagccttaagctcctccatatccggccctgcgcagtaacttaaatccgagataccacaacagtaattgcgctttcccagccggataccgcaggtctcccccgctgccttttgaagcatttcatagagcgcgcttccctgtcctgtccttcccggcaggcggtcactgtgaaaagccggataatacggcggtgcaaatgcaatcaccatgataggcgccgtaatccctgaataggtcagggctgcatccatgatttccagggtcgcccggggatagttccactggcccaggcggatacgttcccccgcatcctcatacagcgccctgaaccattttcccgcctcctccccatgccgctcccggcacagccttaccagttccccgtactccatgacacagcgggacagatccacatccggcagggctgcgccggaccggaccgctgcctcccgggcctccatccgttccatataagaggaaaatgcctcccgcccaatctccttaagccgtcccatgacagaatccgccgtcttcccaaaccccagcatgctcatatagcccgctgcccggtggggcaccgacacatcatacccttccttgcggtccctcaggttaaaccaggtgggcggcggacacggttccccttcccatcgttctgaaaactcaggggccagctccgtgcgcatgaacatttccgccaggaccccgattgcgttcaatccacggaaacaatccaccacatgcgccttcacgccctggaccagcaccgcgggcatggtcttccccacagacccgatatagatctgctgcctgccatcctcattaaaactgggctccagatccaccaggcatccatactccaggccaaactgttcctgcagccccgtaaaaaacggaatggaccccctcataccggctgaataagcctcctcatccgccaccgcggcaaacagaaggcagcccggcagttccggatgttccagcatcaattgcccataccagtccatcagggccatgcccaccgcaagtccccccttcatgtcgttgacaccccgcccgaacagccattcccctgtctcaaaatccgccctggcctcctcaggcagcattgacatcaggtcctccagttcctttccctgcgccagcttccacgcctccacatcatacgcatagggccggaaatccccatactcctcagtatccaccacatcataatgcccggtaaggataactgtccttgaagtgctccccttcaccagcccataaggggtcccccgggacaggatatccccctccagcccatacattcccgtaagttcaggatgcgccttaaaatacggctgccgccccagctcctcccttatgtaatcccctgccgcctgttcctccctgctgttggaaatactggggattgcaaccagttccttcatataacggtaaatctcatttttcatttccataatcatccgcctcactgtcaattatccgatgaacattttgcagcatcgattgccagggccgccataagcacatacaatgcgtcttccgggtttccaatctcaagcacatatgtatcagtcagcttaaacagctgcttggacagccccgctacccgtctccccatggcatcctctatgtaataatcccattccaggatatccccagcaatatgccatcccctgacatccatcttaaaagacggcctgaaaaacgtgaattccttccaaacctcccccaccagccgttcacccacatacagccggaaccttggcaagaaagtaagcacctcctgcttaacagtacccagatgccttccctgcgcatcatatatctccagcctgtgtccccaggccaatttcccctggaccgtataaaccgtcctgccgtcctcatcaaaaacatcgtaactgtcaaaccacgagaaaaacctctgccgaaacaataacttcatcccacatcctctttctccggcccacacccggccatagtccaaaatccttatggaatcatccgcttctaatcataacagcataatcccccttgtcaagccatcccaaaaactcccatgccattctctgccagaaactaacaccaccgcgctcccctttttgaagcgccagcagatgtccaccaccatcccacgccctcttttctgaagcgtcagcggacgtccaccaccaccacccgccccttttctgaagcgtcagcggacgcccaccaccacattcaagtgccgacggactcccacccctgccagtttaaaagagccgaatggcgctgcagcatacggccgcagcgccatcccaattctcccacggacaaaatccctcccccgtccgcgtccattcgacgtaacctacctctcctccctgaaataagccagtcccaggctctcaggcggctgatactccctcttcttcctcaagctggtaatcaccagcaccacaatggtcacaacatatggcagggccttgaaaatctcctgggcccccctgtccagtcccgggatatagagataaaggatatacaggccgccgaacaatatggagccccagattgcattgaccggcttccacagtgcgaagatgacaagtgcgatggccagccagcccctgtcgccaaatccgttattggtccaggtcccgccggaatactccatcacaaagtacagtcccccaagtccgctgataccgccgcccacacaggtggccaggtacttgtacgcagtcacgttaatgcccgctgcatccgcggttgccggactctcgcccacagccctcaggttcagccccttcctggtcttacccaggaagaaagccagtacaattgccaggaggaccgccagataggtaaggaatccataggaaaacaatacctgccccaccactcccagcttagaaagcccaggaaccggcgtcttgtaggccgcgcccgtaaccgccacggaaatctgtcccacgccgcctgccagctttgcaagggaaccgccgaagaagttgccgaagcccacgccaaaggtggtcagggccagacccgtgacattctggttggcccgcagcgtaatggtcagcacactgtacaccagaccgcccagggccgcgcatgcgaatgcgcacaggaaggaaatcagcatccccacaaagccgttaggtgtccccactgaattttcatataaaaatgcaccaatcagtcctgcaatcccgcccatgtacatcatcccgggaatacccaggttcaggttgccggacttctccgtcatgatctcgcccagggcgccgtacagaatccctatgccctgcccaatggccttctgaatgaatataactaaaaatcccatatccttgtcctccctcctaagcctgtgtgtctttgcgcctgctgcgcaccgctactttgtaattgatgaaaaactcacagcccaggataaagaacaggatgattcccgttatgacatcagaggcattttcattcaggttgaactgtgacgcgatctgccccgcgcccttctgcatgaataccaggaaaaaggataccaggaccatggcaaatgcattgaacttgctgagccatgacactatgattgccgtaaatccccgtcctcccgccgtgctggtggatatggtgtggcttgcgccgcttacaatgataaaaccggcaatgccgcagatagccccggacagggccatggtgcgaaggattaccttcttcacattgatacccgcgtacctggccgtgttctcactctcacccaccacagcaacctcatacccctgcttgctgtatttcaggtaaatgaacatggccagggtcagaaccaggacgattaccaggttccacccgtagtccagcccaaaaagcttgggaagccagccgccttttgtagcggagttgatggtgcccaccgagttggacccctttgggttctcccagaagataatgcagtatgtgatgacctgcattgccacataattcatcatcagtgtaaatagtgtctcattggtattccagtatgccttgaaaaatgccggaattgcagcccagaccatggcggacagcgcgcttcccgccagcatcagcgggaacagcaggattggcggaagggaattacccagataaatcatcatggccgccgatgtgacgcccccgatcaggacctgcccctcggcgccgatattccagaaccgcatcttaaatgccggggtaatgccgattgcaatgcacaacaggaccagggtgtcccgtatggtcatccagactcgccgtttggttcccaccgctccgtcaaacacccctttgtacacttcaatgggattcaggccagtaagcgcgaagataacgcctgcacagacaatcagggatatgaggaccgccgccagcctgataagccacgccttgtacggctctatgccgtcacgtttggatatatgcatcagaggttcctttaccgataccgctgtcatttccttactcactctggtcacctcctacttttgtcatcatcaggcccacgccctctttggtggctgtcctgccgtccacgataccgcttatccggccgccgcacagcaccaggatacggtcgcacagttccagaagcacatccaggtcctctcccacacagatgaccgccgccccctgctgcttctgttcattgagcagatggtagatggtataggatgaattgatgtccagcccccgcacagggtaggcaaccataagtaccttgggattggaggaaatctcacgtcccaccaggaccttctgcacatttccgccggacagcttgcgcaccggcgtggtgacgccgggggtcaccacctccagctcctcgatgatatgctccgccaggcttctgggcgtcttcctgtccgcaaagaaaggacggccgttccggtagcccctgagcatcatgttgtccgtcatatccatggaacccaccagtcccatgcccagcctgtcctcaggcacaaaggagagcttcacacccagcttgctgatggcggaagccgacatgcctgccaggttcttttccccgccctcaggcggataatatgtaatggttcccgactccatgggctgtaagcctgcaatggattccaaaagttccttctgtccgcttcccgcgattccggccacccccagtatctctccgctgtatgcggtaaaggtggcgttgtccaaagtcctgacaccttccttattcaaacaggtgaccccctgtacctccagacgcttctggggattgacaggctccgggcggtcgatattcaggctgaccttcttgcctaccatcatttcggtcagggactcctccgttgcctcggctgtctgcacggtcccgatgtactggcccttgcgcagcacggagacccggtctgacagcgccagcacctcatggagtttatgggtgatgatgatgatggaatggcctgcctcgcgcatattgcgcaggactgcgaaaagacggtctgtttcctggggtgtgaggaccgccgtgggctcgtccaggatcaggatatccacaccgcggtacagaagcttgacaatctccacggtctgcttctgggatacggacatggtgtatatcttctggtccgggtccaaatcgaagccgtatctgcccgtcagttcattaatccgtgccgccacgcttttcatgtccaggatttcttttcctgaaaggcccaggatgatgttttccgccgcggtcaggacatccaccagtttaaaatgctggtggatcatgccgattcccaatgcaaatgaatccttgggcgaacggatggccacctcttttccattcacatatatctgcccctcatccgggtagtagattcccgatatcatgttcatgagggtggtcttcccgcttccgttctcacccaggatggacagtatctccccccgcttgacagacaggcatactttgtcattggcagttaccttgccgaatcgttttgtgatgtttttcagttcaattgcgtattctccgctcacccggcagacctccatttttattatttttatcttgcttgcggcagggcgctgtaccagtccgtgtttgaaaatccattcccgccatgcaccccaatgcctccgtggaaaaaagcggagccagtcagatagctccgcttttgcagcttttacaaattcacccagcctggtacctgcgggaaattagttgtcaattgtattaattccgtcaatcagtatgtcgaatgcgggcgcagatgcaaattcggactcatggaaatatccgtcggaaatgtactcattgccgtcatccttcttatatttatccagtgtctcgcccttaacggtccaggtggaggtatcgaacacatgaagctcgcctgctgccagtttggcctcaacctcttccaccttttccttggttcccggggcaaccgctgcttcgttcagttcagtgataagcactgcgccgtctgagaagcccttgcaccagtcaaccggaatctcggttccatccacaacatgctgtacggcctcggtcacatatgcgccccagttgttggtggaggatgtaagggcctgggtaggagccgttgcaatcatggaaatgttgtagcccacacatggaacgcctgctgcctcacatgcagtgggggcgccggttgtatcggcatgctggctgatcagcacgcagccatcggaaatcagggcgtctgccgcttccttttccaggtcaaagctggcccagctgttggtgtacttaacttccatggtggcatccgggcatacggagcgcacgcctaagaagaaggaggtatatccgctgataacctcagcatacggataagcgcccacataaccgatcttgcaggcatcctttgcaacggtcccgtcctctatcatctggttcagcttcagtccggcaaccacgccagacacgtaacgcgcttcataaatagccgtgaaatagttatgcatgttgctcagtccgctggatgctgcctggaaaccggtagcatggcagaactggacctcaggatactccttagctgcctcaatcacataggactcatgtccaaagctgttggcaaatacaatctggcatccctggtcagccagatccatagccgcatcctgagcagtctcatcctccgggatattccatttaacgataatctggtcatcggacaggccaagggcatccttcatctccatggcgcccttataatgtgcggccgtatagccttcattctcatcaccgatgaatacaaaaccaacctttaaatcttcctttgccacaccgcctgcaggcgctgcctctttggcctctgtctcccctgcttctgcagcagtggtgtctgccgccgcctctgtggacgctgccggcgccgcggtcgtatctgctgttccggaaccgccgcaggctgccaatgacaatgtcatcacacccgccattgctacgctgactaacttacgtaatttcataatgctctcctccatgaagttgggatataggcacatccagacgaaaatacgtcaggtattggctgccattgcccctgacgttccatcgatgtcctatccgttaaaatgtaacacaaatacgtagttaagtatatcactttttccatcattgtcaatattaaccatttatttaaaacaattttatacacaataaagcgggattggtttaatttatcaccaatcccgccttatattcttaagctacgcttatatttcaggcctgcgcccggccattttcactgaacacctcgcacataatcccggcgcccaaacggaatccatgactgaacgtctccgtcttttccagataagtaagctccagataatgctccatcagggtatcaaattccgccttcattcccgcgtccagcttctccgtgaagcgctccacttcctttagggattccctgcacagggcctggtaatccgctgaatcctgcatcacacagtcagcggggtgcagatcccctgcatataacatgttcaaaatttttcccattcctgttcctgcctttcatctgtctgtatgcaacaggggcgaaagcattcatgcccccaccctgtccatacttccagaatagcacagccccaggtcaattgcaatggacggatggctccttattaaatatttccatgaactcctcacctgtaatggtctccttctccagaagataagcggcaatctcatgcagctttccttcattttccctgaggatgtcaagggccttggcgtgctgccccttcacgatgcccaccacctgctcgtcaatgcgtttcgctgtctcaggcgcgcaggccagggacgtgtcaccgcccagatactggttggtcactgtctccatggcaaccatgtcgaattcatcggtcatgccgtagcgtgtcaccatggccctggcaatcctggtggcctgctcaatatcattggacgctcccgttgtgatggaatggaaaatcagttcctccgcagcacgtcctccagtgaaggtggcaatcttgttcagcgcctcctccttgctcatgagataccgctctccctgctccacctgcatggtatagcccagggcgccggaggttctcggtatgatggtaatcttctgcacaggtgcggactgggtctggcaggcagccaccagcgcatgccccacctcatggtatgccacgattttacgttcttcctgggaaatgaccgcgtttttcttctgatatccggcgatgacggtttccacgctttcttccaaatcaccctggacgactgccccgcggcccatgcgtacggcccgcagcgccgcctcattgatgatattggccagttctgcgccgctggcccctgccgtggccctggcaatggcgctgtagtccacatcatcggacatcttgacattctgtccgtgtacccttaggatggcctcccttcccttcaggtcaggaagttccaccggcacacgcctgtcaaaacggcccggacgcaggagtgccttgtccagtgattccgggcggttggtggcggccaggatcacgacccccttcttgccgtcaaatccatccatctcggtcagcagctggttcagggtctgttcccgctcatcattgccgctcataccgccgccgtcacgcttcttgccgatggtatcaatctcgtcaatgaatacaatacagggcgccttatcattagcctgcttaaagaggtcgcggaccttggcagcgcccatgcccacgaacatttccacaaattccgaaccggatatggagaaaaacggcacatgggcttctccggccaccgccctggcaagaagggtcttaccggttcccggagggcctaccagcagggcgccctttggaaggtttgcaccgatatccgcatacttctggggattatggaggaaatccacgatttcctttaaggcatccttggcctcctcctcgcctgccacatccgcaaatgtgattcctgtttcattctccgcgtaaatcttggcattggatttgccaaaggtcatggcgttgttgccgcccatacgcttggaaagcatacgccccataatctgcccgatgataacaaacatcaggatcggggccacccatgacatcaggaaactgaggagcggggacgccttggtgggaatctgcctggagtaattgtccaccttcccctcactcttggctgtctccagacgctgggccaggttatctcccggcaggggccctgtcttataagaagcaacattccactgctggtccttggtagaaaactggatctgcgtctcatcactgctcatgtacacatcttttacattgcctgcatccagctgcgtgataaactcactgtacggcacctcgacggtatgctccatcatagggaataccagtgcgttcagtatcatgacaatcaggatgacaaggaaataatagtaaatgaacggttttttggttggaccgttcttcatatcccgctttccattatcttcattcacacccatataggttctccttttcttcttcatactcttctatagtatcgccggttagataccggcctattacggctggcggcactgttttactggtcatgcagcatagttccgtgcactgcagtgtcatccgccatccatctgtaagataatacgaaaagcaatatttgtcaatcttttattgtaaaactttatttacttttaatatttattgacatttaatcaggaatatggtacaacgggtacagagaacaggcgtggatccagctagggttccaaccagatatccgcgccctgacagaggaggtatttataaacatgactgaacataccccggattacaggacggtaggtgaacatttcctggattttaccatcacattctttaatctggcgaaaagcaaatatcagcagcagaaccagattaaagccaactccgtgggtttccaggcccttatcctgttaaaccagccgggccgcagcgcccccaccatgtcggagctggctgcgcggctggaaatcaccaagcagcagctgaccaaactggtcaatgacctggaggaaaaagacctggtcagacgggagcatgattccaggaacagacgccaggtctatctgtacatcacccccaccggagccgccattgtcagccagttaaaggaagccatgctcagctgtaccgtggcaggcctgtcgggtttctcagaacaggaactgaaggaactggacaactgccttacgagtttatccggcttactgtccaaattcaacccggatgcccccggagccgttaagtgcccggagtttcccagtctgtgaacagaacctttaaaaagttaaaatccaggaaatccctttcctcccacacatacggccgattctgcaacagaataaactggtcgtatggttgaaagtccgggattccctggattttctattttacctgtcaatctggaccgtaatcctacagcaccttgctgaggaaggatttcagtctctcattcttcggattcccaaagaactcctcgggagcggcttcctccatgaagtacccctcatccatgaacatgacgcggttggcaacctccctggcaaagcccatttcatgggtaaccaccaccatggtcatcttttcctttgcaaggtcgcgcataacgcttaaaacctcgcccaccatctcggggtccagggcggatgtgggttcgtcaaagagcatcacatccggcttcatgcagagcgcccgcacaatggcgatacgctgtttctggccgccggagagctggcttgggaatgcatgggccctgtcagccaggccaacccgctccagaagctgcatggcttctgtctccgcctcctgctggctttttccctgcagtttcatgggggcgagggtcaggttcttcatgatgtccatatgtgggaacaggttgaactgctggaacaccatccccatcttctggcggtgcttgtcaatattgaccttggggtccgtgatatccgtgccttcaaagaaaatatgtccctgggtgggttcctccagaagattgaggcatcgcaggaaggtgctcttgccggagccggacggccccaccacgaaaaccacgtcacccttgtatatatttacattaattccctttaatacatggatgctgccaaagctcttgcccaggtcctgtacccggattaacggctcgttattcatattagcgctcattctgccttaacctcctctccagaatctgaatcagctttgtaaatatcatgacaatgataagataaatcagggcaactgcaatcaagggcatgaacgcgctgtatgtcctgcttcggatgatgtcgccgcccttggtcagatcctggattgcgatatatccggccacggatgtctcctttaacaaggaaatgaactcgttgcacaaggtgggcagcacggtcttaaatgcctggggcatgatgatataccacatggtctgggcataattaaacccaaggctccgtcctgcttccatctggcccgcgtcaatggacatgatgccgcttcggaatatctcagccacatatgcgccggaattgatgccaaaggccaggatggccaccaggaccttgtcaatcctgatgctgccaaagagcacgaaatagatgattaacagctgtacgattacaggtgtgccgcggattacggtcaggtacactttgcagatggcatttaacagcttcagcttgtgggtcttttcgtaggtagagcgtatcatgcccacgataaagcccaggacaattcccatcaggcaggcaaaaagtgtaataatcaacgttgtcttgagaccgtctgtcagatacttccagcggttctcagaaacaaagttcaggtaaaatgcatctgtaaacgtgttccacatgctcatcatcctctgctctctattctatagttaacccgtaaaaactgccgcagcctgccggaacagatcctgtttccttcccgcagcctgcggcagtccaataccggcccattatgccaatgccggcactctcatgtcgttatgtcagtagtcccggctgattactccgccttgatgtacttggcaacaatctcatccagggttccgttatccttaagggtctttaatgcgccgttaatcttctccagcagctcggtgttgcccttcttgacagcgattgcatattcctcatcggtgaaggattcctcaaggatcttcaggccctcggtctgtgcaacaaatgtcttggccggctcgccgtcgattacaacagcgtcaatcttgccctggcttaatgcctggacagcctcaaagcccttgttgtaacgctctacggtggtgccatctgcttccaggtcagacacatagatgtcgcctgtggttccctgctgcacgcctacgataacgcctgtcaggtcatccggggaagcgattgcgctgtcttcctttacgatgatcttctgggaagcctttgcataagtatcagtgaaatccacggactgcttacggtcttccgtcacagtcatgcctgccaggcccatatcagccttgccggaagtaatctcaggaatgatggaatcaaatgcaatgtcctcaatctccagttccatgcccagctcgtcagcaatggcctttgcaatctctgcgtcgataccgacgatttccccgccgtcatggaattcatatggcgggaactctgcgttggttgccatcaccagtacgccgccagctgcttctgtcccagctgcctctgcgcttgtttcctctgtcttctcagctgcggttgtatcggctgcatcagcatttgcagtcgtatcagctgctgtggtctcttttgcaccgcctccgcatgcggtcagggaagctgccataagtgctgccatggtcaatgctaaaactttcttcttcataattactctcctcttttcttttatgcatcaaaatgcataactataaaaaaattattaacgttttatattataaagcatttttaaagtttagcaagaggaaaatacgggaatccgccttatttttataatttccgctgtttttccggccattcccggcaggatgcctgtcagccggacttctgtcctgccgccaagaggagatgcttggccaggaccgccgtggtcaccgcgccgacgcctcccgggacaggggttgccatggatgcggcaccggaaatggagtccatatccacatccccgcacagcttcccgttctcatccacattgatgcccacatcaatcacaaccgcgccctggcccacatacctcttatccagcatcttggcccgccccgcggcagccaccaggatttccgcggaccggcaggtgccctccaggtccgctgtcctggtatggcagatggtgacggttgcattttccttgagcatcagcatggacaggggacgtcccaccaccatgctgcgtcccacaatggtaacgcgttttccgcttatggcaatcccgttggccttcaggacctcgatgacagcttccgccgtacatggggcaaatcccgtgccgtcccctgcaaatacctttgcgatattggacggcgatatcccgtccagatcctttgccgggtcaatcatccgttcgatatccgcctcacagatctgttttggaaggggacgcagcagaaggattccggtcacatcctcatcctggttgatgttcctgaaggcttccttaaaatcctggtcgcttatgtccgcggggaatacataggactgcaccctcagcccaaagccctccatttttttgatggccccccgctcatatgacatgtcatccgggcgttcccccaccctgacgattgccagcttcggtacattcccccccagtttttcaagcatccgggctgcctgttcctttatctttgcagatacctctgcgcctttcagtaattccatggctgtcttcctttctgactttctgaaaatgtatgttcttttacacgccccgggcctgtccggacatgcatccctcccggcgcagcccctatctcagctgatccagcaccctggcgtaaatccggtccgcccacgcagtcccctcttcaatcagcttcccggcccttgcgttcagttcctccgccttctccctgtccttcatggatctggtgttaatatacacattcatgaccgctcctaaaagcgcggtgcggataaactgcacgcccacgcccacatcgctgaccgcaaggcggctgcccttgtccccaaggatttcaaggatacccagcatggcagacgcatgttccatgatctcaaggggaacaaggctggcatccagaagacgctcttccatgaccgtttccttataagccttttcttcctccgtggcagacggaagtccgtagcactgtgccaacggcgcaaatacttctgcgtcccggtcagccagcgtgacaaagacggcctgaagttcctgcatccgtccgagaagttcctttatctcttcttccacgcccgcgtactttttctttccaatggtcaggttcgcaaccatctgtcccagggcattgcccagggcgcctgccagggcggaagcccctccgccgcccggtatgggttccttggatgacaggacctccaggaatccttctattgttttctgttcaaccattctgttctccttcctttatccttttgttcatattggactgcagtccgattatgtcacgatgtcacacaaccttaacccccatcagcttggcaagttccgctgcctggaaaagattcaccttcacacctgcaagctccgtatactggtctgataccattatattgtcaatggtgcagtctgacaagtccattcctctcagcatggtcctgaaaaaatccacgctggtgaaatccgtcctggagcatatggttttcttgaacctgacctcggacaggaacgcctcccttaagctgcagcccgttatctctgagaattcccagtaagccatggaaaaattggcgtaccggaactggctgtccgtcagcttcacccacttaaagcttgcattggaaaaacggcttccatcccctttgcagccctctgcccttgtatttttccaatagctgtccacaaaagagctgttggaaaaatcacatttatcaaacaccacattgcagaaggatgcccccgtaaaatcacagtccgtgaacctgcatcttacgaaatggacggaatcaaattccagcttctgcccactgacagagtcagctgtttcatccgtgtatgtccggtctgatacaggccattcctctgcggccgcctgcaggatttcttctgttaacatagtcttccccctatctgttggacttggcgcagagttcctccacatccaggcgtatgaccgctgtcagcttaagcatggggtccgggtattcccaccgtccgcctcccgccatgtgttccatgatgcagtccaggccatggcgtttctcctccgggtcatccaccatggtaatccttcccttgcccacaatactgctatattcaaacgaaaaaccgcacgcctcatcagccgtcaccaggcggtggtccgtatccatctcaaaaccagcgtatccattctggcgtatcagatcaatcttacgcccctgggctgcgccgtgaaagtaaaatgccttcccggccttgtcatatccgaaattcacaggcacgatatatgcacatgccccatctgcaaaagcaatcctcatgcactggcaggcatcgatgatttcctgtatccggtcactatccgtgatttccctgtcttttcttctcatgtccgtttctccctgtattgatttgtcaaaccattgtttcatccaaaagccgtttcaaaaagtattccctgttgtttatgaacatttccgttacctggtagctctccgtctcctcatagcttaccggttccagcttcccgttgtcaaaggacaggatctgggcccctggaatgccgaggaggatgggcgaatggctggcaatgatgaactgcgccccgcctgccgccagctggcagatatggatcagcagggtcagctgcctctggggcgaaagggctgcttccggctcgtccaggatatacatccctttttcctcaaaggtattctgcatcagggccaggaagctctcgccgtgggactgttcatgaagcgaacgtcctccgtacctttcataataccacttagggtcgtccccatccctgtattcctctatctgggtagcaacattataaaagctctccgccctcaggaaaaaaccatgccttggcctgtgtacccctttaatcagggtaatggcgccgtaaagctccgaatgtgtctgtctggtggcaaagttaaaattcctgcttcctccctcaggattaaatccataggccaccgcaaccgcttccaaaagcgtggatttccctgttccgttttcccccacgaaaaaggtcacattgctgtgaagccgcaaatccctgataccgtggattgaaggaatatccctgacataggaatcctcatccaccttatcccagtcaatccttatttccctgataaacatatctgactgccccattccatgcatctcccctgtgaacaccgcgcccttaaacctgtatccgcgccctgctgcccccgctcttttccttcaccaccacaatctggcgctcaatccgttcctttaattccgttacatgggaaatgattcccaccagccgtcttccctctgccaggtcccccaatgccttcattgcaaggttcagcgtatcctcgtccagggagccgaagccctcgtccacgaacatggtgtccaggcgtatgccgcctgccgcggactggatttcatcggacagccccagggccagggacagggatgcctggaaggactctcctcctgacaatgtcttgacgctgcgctgggtgccgttgtaatggtcaatcacgttcaggccaaggccgctttttccgcggttatcctcctcggtgcaccgcttcagctcgtactggcccccgctcatcaccatgaacctggtattggcccgtgcgatgatccgctcaaaatacgccatctgtacatatgtctcaaacgtgattttttcctttccgcccacttcgcccgaagcagtatcggacagggatttgacccaggtccactgctgctgtatttcctccatggcgtccttctgcttcaatatccgtccgtatgcggtgcggttggtttccaggcggtgatggatacggctctttgtctgttcctgtgattccagttcagcccttaccctgccctgggcagcggatagttcctccatctgcctgcccagtcccaaagcagtcacttccccgtctatcctggcatcctccagctgcgccctcagagcttccatgcgcgacctggcatcggcaaccttctggtttacttcatgatatactttctccgcttccctgtaggccttttccccggcctcaaaggccgcccgtttgccagccagttcctcctgggcctgtttcctgtcctcaaagggaagttttccagccagttcctttatctgatgttccaggcctttttcccgttcttctgcttcaataagaagtttcagggcctcctgcttcctctcccctgcttcctccagggatttctgatggcccacacgccctttctccagttcttccttatgtttcaggcgggcgcggcagtccgcggaccgctttttcgcagccgtttcctggcgggccagctggtccttaagttctcccagcatgtcctcccatactttgaggaaatgctgccggcccccggggctggcagcattgccggatggactactgaccgccccttcatccgccctgcattctgcctggttcaggcgttcccgccacgattccttccaggaccctacctcggcatcaatctgctgcctcatcctgatataacgcgtttccaggccgcctgccagccttccggccttaaggcttagttccgaagcctccctggtcctggcttcagaatcctttgcggcctggtctaccagttcctttgtcacatcaccgtcagaatatgggccttggaagatggtttcgggcttcatcccgcccggaaccgtgtctgcccggactgtgtctgcctgaacctcacctgcccagaccgcgtctgcccggacctcacctgcctgtcctgcgtctgcccgaatctcacctgcccgtcctgcgtctgcccagacctcacctgcctgtcctgcgtctgcccgaatctcatctgcccgtcctgcgtctacccgaatctcacctgcccgtcctgcgtctgcccgaatctcatctgcccgtcctgttcctgccggagccggatgcacggtggaaccgcacaccgggcatggttcgccctctgccagttcccttgccaggattccggcctggttgtccaggaaacgctggtacaggcttctgtatacctggtccgccctgcgccgcttcccgtccgcctcccggtagagttcctgggcctgctccaggtttttgcgctccctgtggtattctgaaagctccctcacaagggaatccacccttatcctgtactcagccagcttctcaatggctaaccgggatgcctggtaatcctccccggccgtcttaaggtccgccagttcattgtcatcctttaaaagctgttcccgccaccgcgcttcctcctcctgggtccggagcgccatggcctttagcccggcaatccgcttaaggcattcttcccggcccgcggtcaggccgtcatactgtacgtatgacttcatggcctcttccatctttgtgatggtgaccatcaggatatcccgctctgcctggccttccttttccttattataattgcattgtgcagccgccagcctgggagcctccctgtccaggaccaaacgggctgcttccatgtcctttagcgcctttgacgctgactgcgcctttccaagcttcagtcccagggcggacatctcctcacggatggccttcatcctcccgtctgcggcatgttcctcttccatatccgccgtaatcatctgttccagcagctccagcataacctcaaggcttcccttttgcgcttccttccaccggattgccaggtccgccctctcttcgccgggaatgacgccgtccgtatactgcccaatgctcttcctggtatctgcatactgcccatacaacgccttagcctggtcctttaacttctcctggaactgctggtagggcctggttccgaaaatctcgcggaatatggttccccggtcctctgtcttaccggaaagcagtcttgagaagctgccctgtgccagcatggcaatctgggaaaactgttcacggctcagccccagcagggtttcgatctcctgggtcacggccttgtcccctgtaatcacgcgtccgtccggcatacgcagttctgcatccggcttctcctttgtctccccttctcccctctgctttgcccgcatgtattcaggattgcgccgcacacaatatcctgcctcattgtatacaaacgacatttccacaaatgtccttgcgtccatgggcgcatatttgctccgcagcatctttggcctgcgtgcctctccgctggcatttccatagagggcaaatgtaatggcatcaaatatagtggtctttcccgcgcctgtatcgcctgtaatcagatacaggccccggtcccctaaggcatccatatccagtttcatttcccctgcatatggcccgaatgcggatatggttaattgtgtcggtctcaatgtacatcctcccagatcatttccatcagttttaaggaaaactccctctgccggtcactcatgggctggttattctgaagttcatacaactccccgaacagctccatgggcgatttgcgtatctcccccgccttatccacggactgccccgacctggtgcgctggttgtcataatccagcttcatcacattgggatagatggaccgcagtttccctatggcatccagtatgtcatcttcatccgtcagggtgatatgcaggtagtcatccaccgcggtcccctggtaaaatcccaggtccgtcacctgttcatagcttccttttatattgcgcatatcgtgcagcggcttaaggggcctggtggatacggtcacatttcccttttccaaaagttccactacggttacggacttcttatgtcctgcttcggaaaatgaatacttaagcggggtgccgcagtagcgcagggtatccctaccaatcctctggggtccatggatatgccccagggccacatagtcaaaatcccggaaccagtccgcgcccacctgctccagccctccgatggacagttcctcggagtcacaggccgaggcccccatgacaaactggtgggccatcaggatattgcgttcaccgggcctgaagccatccttagtcatgtgcgccaaggcacagcccaccccatcatcaaagccctggatttcctcatccgggaaacatcgccgtaccatggccggctttatgaagggcagcatatagatatatacactgccgtaagcatccttaagctccaccggctccacatggccgtcatacaccggggccatatgcacccctctgcccaccatcagcttcccgccaaaggccagacgctccgggctgtcgtggttcccgctgattacaaacacaggcacgccgctgtcagccaggctggtgagaaatgcatcaaatacctgaaccgcctcggcaggaggcaccggcttatcgtatacatcgcctgcaatcagcacagcctccggcttctcctggccgatgatggacagtatctcattcaatatatatttctgatcctccagcatgggaaattcattgacacgtttcccgatatggaggtcagacagatgaatcagcttcatatatcttccttcctattatttccttattccccaatatccacaccattgtacccaacatcataccacgcttgccacatccattacaagcatttccattgcatggaaatggactctgtggtaaattaatactatcatacaatgaggtgaaccaatatgaatccaatgcttatcctacagttaagaccagcctgggaacagtttaagggcaaccacccaaagctgctgaattttgtaaaggcagcctccaaagacagcttcatagacgaaggctccctgattgaaatcagcgtcaccaacagcgccggaaagaccattgcatccaatgtacgtgtgaagggggatgacctggcctttctgtccgcactaaaggatgtgctggaaggggattaacgggactatcaggactctatgagtcagatgagccaggtgcgcacatccatggtgtaaacgcagatagtgaaacataaaaagcggcgtcagacggttcccggtagttaggaatcatctgacgccagctttttatttatatcgttcctcaagaaactcccattggtcctttctgtctccgtgttcaaaaaggaactgttcaaccgggcagactttactatcgtccttggaggatttcacaagggggattacctcttcataagtaacagcaatccctctttcattcaatatccttaacccgccttctgataccctggctgcatggcattccctgatgggaatctgctccgccatgattcccatggcaatgccggcctgattggcatagaggaccagatttccggttccagtcaaaccgccctcatagtatgcgtgatacatgcctgccaccgggcttttgtctgtttcccatatgatgctgccggaatcatcggtcaggattgcaagggcttccctggttgacaccttctgtaacaaatcctctctcatcatgtcacctgctctcacctttacagcctgtcagccgcctccttgattcttcttaatccttccatgacaaccgccctgggcgctgcaaagttaaacctcatgaacccgcttccttctttttccccaaaggtggttccgtcatttaacagtaccttggcatccttaaacatgaagtcttttaattccttctgtgttttgaagccaaggccgcggcagtccatccagatcatgaaggttgcttccggattaactgcatggattttggggatgttactgttaatgtatgcaaccgcctggttcttcgtctcatttaagtatgcgacacactggtccgcatagtcatccccatggttatagcatgccatcaatgcaacatttccaaatatattgcgtcccatgccctttttgtaagtctgttggttcatcatcctgcggtagatttctttattatgcgtaaaccatgcagcggtacggaagccagccacgttgaaggtcttggcagggtttatgaatgtcacggaatggttggcaaattcatctgagatgccgcagaacggaacaaattcatgtccgtcaaaaatgatatccgcatggatttcatccacaccgatcatcacgtgattgcggatacacagctctcccatccttaccagttcctccctggtaaagcatctgccggttgggttctgggggttgcagataaaaaggatttttaccttggggtccgctaattttctttccaggtcctcaaagttaatttcataccgtccgttaatcaggtccatttcattgtagacaagctggcgtccgttatttttcaccaggtcatggaacggaggatacaccggggtctgaaggaggattttatcgccgatgctggaaaattcttctgtaaaccagatcatgaccggtatcacacatggtgagaaatctatgtactcaggattcaggtccgtatcatgcctcaccttataccacctggcaatgctttcctcaaaagcagtatcaatatacggataaccgtagtggttaacctccacacgctcccttaaggcttccgtcacttcaaccgggcttgggaaatccgtgtccgcaatccagaatggaagtacatcctccgggcacagggacgggtcatacttctttgcatcggttcctcttctctctacacctttatcaaaatcatatattatcttactcatgatgaaatctccttttccttatttaataatagcatattatcgtccattttagacaatcgcatatgaaacaatcaggttacatacaaacatgaccacggccgggacagagcaccttttcacaatgtccatgatatccagttccgccatgcctgagatggcaatcacaacgcccgccaccggtgacatacagcgcccgataccggatgacagctgcatcggaagtgcaatggtggcagtggaaacccccatctgggccgtcacatccggcaccagcggaccaaaggcataccaggacgcattgcctgaacccagcagcatgcctgcaaagaatgttatcatggacatcaatgccatggtaataataggagcgctcttaacagctgccagggtattggatatgattgtgataccgcctaacagtttgatggcttccgcgaaaaccgccgcgccaatcaggatacttacaacattggcaaatgagttccccattgctttcatcacaacgctgaaatcagccgtcacttctttcctgtcccttctccttaccagttccaggatgaatacgaagaacagtccaatcaggttggctgtaaccacatccaagctgatggagggtatgaagctgaacacggtaatcagcaccaggggtacgatggggagcagcgcatagcacgcggggcagctggcatcctggggcatctgcgcctttgccacggtccctccggctgatacgtcctttttgtccatatgcctcagatatatgggcaggaacacggcacagataaggataagtatggctgcggtcttcccctggtaggtaaggaaataatccatcatgggcattccaaccacattctctgctgcaaatatcgcgcttgaatcattggggccccagtcgacaaagccacacatgatcatgaccgtggcagcgctcagtttactgattcccaacgaggtaagtatggggaatgcaatggccattaaaagcatggccaggcctgcgtggcttgtaatcaccagctttaacagggtgccgatgataaagagcatgcttaaaacaatatatgggttcttaatcttcgataatggcttggttgccaggtatgccagctttgtggacgccccgatatgggacatgtaaacagcgtatcctgttaccatcatcagggtcagtccaacgccggatgcattggacttaaatgcattggccgcataagcgaacacatctatgacagcatttccggtagtcttatcccccatgattgaatgaccgccaatgatagccgatatcagcaggattgccatacctgataccaggaatacaaatacagaattatactttttgattaccagcgttgcaactattactatgtatagcagcgttaatatcacagctatggtattattcattctacctctcctgtctcttgcggaaggactgtttttatgttccggaaaataatacagattccacaattctttcatgattagtttttcccaaaccggcctgcagtaccggtttgtgtaatgatacaggtatacaggactaaggtttattgtttagattcttaacctttagtttagtatgtatacctcttgtttagattctaaaccttttaatatctattgtcaatattatttatacactttgtcaatatgcacgaatatgatacctatattttgtgcaatatatctaattttattcttataaaataaaatactcccttataccgcctgcccggaaagcagcaaaggagccgcagcaaccgctgcggctcctcaaccgtcttatcagtcatatatccctatgggattcgtgccatagggttcttattatgggcttcttattatgggcttcttaccacatacttctgctatttatctcttcctggccttcttcttttcattcctcttatcctggaccctgcgccttatatccagccatgcctcaagcacgcggaacgtggtattgatttcatcctcggagaactgttccctgaccacatccattgactcgccaaaccctacctcatcgtacctgcggtgggcttcatccagttcttttcctttatcggtcaagaacagatggtagcggttatcattctcaggatccacttccctgtaaaccaatcctttgctttctacctttttcaggatttgggaaaccgcgcctttggtctttccataatcccttgcaagctcagtcaccgtaattccatggtggtcggcaatatgctttaacgtatgtacctctaccgaagtataggcttcacctgttccataatcatgaggcacttttgtagagatataaaagttcgagacctggtgcagtatatcgaccgcctctacatcgttatatgattttcttgccttctcatccatacttatactcctaatcctgcaatataccttatccgccttaccatgaattgttaaagcattgttaaaagtatactatatttagatatcaaaggcaagtttttattcagtccgcttcaggtactccataaacgaactgccattttgaggcgcctttacaccaaaggaatcacacacacttgcacccacatcagaaagggtcttcctggtccccagcatctttccggtcacgccctttttatatacaagaagaggtacgcactcccgggtatgcctgctgtgtccgattgcaggatcgttgccatggtccgccatgaccagaagcacatcctcaccggtgagaaggggcagcagctccccgattcccttatccgctgtctccagtatccgttcatagacggctggggactgggaatgcccggccaggtctgtttcctggatattcgtgcagatgaatcccttctccatatgtctaaattcatttatggtgtgctccatgcattttgcagtcggcacgcaggaaatgcttttcccgccgttgtttgacacaatgtccgccacctttccaataagggtcacgggtatcccggcgcctgtaagtatggttggggcctgtacattttcatcaaccccgtatcccaggtgaaggcactggtagccctgcctgtatgatttggactttgctgacgcgattccgataaaggtattgtcctttatctcctcggcggcccacagatcctccatggtgttcccggtcccgccaaacacaatcacacggcccactgtcaccacctggcgtaccagccgcccaatcccatactccttttcaaatggaatataatccaggggagccgtcacattgtagcacattcccaggtctgcctccaggttgtctgccactgtcacgtaatcgtcacagagcacatagcgcagacccttccgctcaatgatttccaccttgtgcccatgttccctcagatgggccgccaccgcgtccaccttttcctgaaacggatggacatcgggtttgcgcgggaatgtacccatgatttcctgatgccccataaaggtatcggctccaaaatgcatcagctccaaccggccgaaattggcatcccctgacatcttcatccggctgctttcagcgccgtaggcattcatcagccccagcttctccaggtttggaagcttcatatcaggatcatgcgccaggatgcttctcagtgtattggccctctcgtccccagggcgcgctgtcacggcatcgtccattgcccctatcccaaatccgtccaacacgattacaacaaatctcttcaaaattcatccttctttcttccctggctgtcataaatgcccacaatcccaggacacccttcctggattccctttaccaggaccacatcgcttcttgtaacaaaaatctggaaccggaacgccatcacggccgtgtcccccaccgcgcattcctcagatattccaaaatgatagtcaatgctctcatcggtgggtggtatcaccgtaagctccctgctgtgcccaagggacgtgcccacccgcaccttcttaacatgagaccgcctataatgaccgcctccaaagcaatatgcattgcccatgaaattatgggaaatctcactgacatataccacggccggcctttcctccagttcatataccgcatgcatgggcgttgtcccgctgagcccatgtcccggctccccgcagttgcctccaaactccgccatcctgtcaatggtcctgcagcaggtggctgacggggtattgattaacgctatgtcaatgccgcaggtcttcaggatctccaccgcacattttaccgtctccaggtttttggtgggcagcacgtccccggcctccccgtcatagagatagcagggaaatgaagtcacgccctttatctcaagatgggggcactccgtcttaatccagatagcggtctccttcagttcatccaaatggaatcccgctgtctgtccggaatatatcatgtcaaaatcaccatatacccgcagcatcaccgcctgcctgcatccaagaccggctgccgctgcctcgatttccctggccttttccctggaataaatggtcattacctctggtttatatgccaccagttccttaatgagggcccccggcgcctgcaccagatgtcccacatttccgatgggaatccggtttttcatcatcacaagggcttccctgaaatccacaaccaccgcgccgctgtaacccatttccatcaatgcctttgccagatatgggttccgtccaatctgttttaacatgaagtacagcctgatatggttctgccctgccttttgaaggagcctgcgggcattttccagaaacacatccacatccaccaaataggaatccgggagtatcttcccctcctgatgaagcatgaacgcggtttccactaattggggattccgtctgattgtctggtccagaaacatctacttcaccctttctactgattcctttatgattcttaagattgtatccgccccggcacgcatggggttaatccttatcatgcggtgttccagggtggggtcggctctacggaaggtgccggagacccggtagaacatgggaatcatctcgtattttgattccgcgccaacgggattgggggcagcccccagtttctccgcctccgccagtacctgtcctgcaatgtcttcctggaattccaccagaagcaccttggactgggcgtttgccagaaatgcatccctgacctgggtaatctcgcctgccttcagcctttttacgcactcctcgcctacctgggcttggattgccagcgatacgggcgcataaaccaggccgtggagcacatccagggcctcatgcccctgggtctgcatccctccggaataactctccgatatgagacggtctatatagcgcttcctgcccgcaatcaccccgatgccctctggccccaacagcttgaaggccgaaaaacaggacagatccgcgccgcactgcactccgatgtcctttaccttcattaccgcataattatcatcggttaggaccgggatatcccttgtacgcttgatggtcctgacaacctcatgcatatcatagcggtcatccagcttctgcctggtatactgtaccagcgcccccttgatatcaggatgggcatgaaggactgcctctatgtccgccaggtcattaaaatccgcctccaccggaatcagccccaacatttcaaaggatgtgcccgtggtattgtaaaccggcgctttgtgcaccagtatcttatccccgcatgccagcatggcgtgaagcccgaaccgtatggcgccgcttccggcaccccggaccaggacacatgcttccgtatcaaaaatacgcgcaatcaccttttccaccttgctggtcgtaaccggcttattaagccccatcaccacgccaaggtcacctctgtttaaaaacgcgtgtccttcaaattctcttgtaatacaatccgtcactttaaactgaagctttactgcctcctcaagggacaggctgttaagcggatatgtctgcatgtctgaaacctcctaatcatactgtctgcccagaagaatcctcttcggattctcctttagcaacatgtctatcttcgcctgtgtaaatcccacttccagcagcagggggatgaatacttcaaacatataagcatatccaatccctcccctggacttcaggtgggatttccttgtaatatccatggaaagcaccacctgggaaagcattccctcctggtcaatccgcttcagggcctgtgcgcggaaggtatccgggcagtaattcagttttcccactgtgtcaaagcctacattgacgcccctcttcaggacatcaaggataacctccacgtcctgggataaatccatgtgcccaataatgatgtcctccggccttaccccatgtccaatcagataatccgcctgctctgcgcccatggttcccagcgtggtatgggttgtcaccggcgctccggtccttacagcggccagggccacggcgtcaaataccttctgctccatatccgtcatctgccggttgctggttccggattccccaatcacagacgcacgcatccccgtatctcccggtacagactcccatgggccgttaataccctgtgtcagttcctgttccatcataaaccccagttcctccacagaccgcccgtatacacagtccggcaggaacggctccttgtaaaaccccgtggacacaagaatgttgattcctgtctcctcagacacccgcctgatgtaccccacatccctgcccatccccaagttggtcacttccagtatattccgtaccccatatccgtacaggcttttaaactctttcacagtttcctcaaaacaggtaagcctgcagtcctcatcctttttcacgcctgacagatcaattgtcacatgctcatgcatcagcgtataaccatctgctagtttcatttttttctccaacccgtccatacttgacaattctttatctattccccgagaagcccttcctctaaggccccataggaaaaataggcatccatgttcctgaaatacctttctatcagttcgtcttctaccttcggaaaatcctctgcaatactgaacattttttctatcttctctttttttgactcacacagcagcacatagccgcttgcaaaggcattgtctggaatgcacagggctgttgcaccaaccatattggccaccctgattaaaaatttgccgctttttaactgattctcctgggtttcctcatcaaaatggccaagaatactatctcctataccatttacatcaatctttttttcgtaatgaatcagcacgtcgcagccaggaagatactgtttcaggaaatcaatcatcggctccctgctgttatcaaaaacaggaaaatccactgtttctatctttatcttggtttttttatgaatcttttccggcagtttttggtgttccttccatacttccgggcagattacatgtacaggcatatcgttttcccttaattcaaggcagattccggcggctttctttattacagctaagtccctggtaataaatcccagagatggcgtaaaacacaagccatccgtggaacatttcccatactgtttcatatgctcctgttccatcaacgggctgataaatccgtaacattgtacactcattgccggagcaagaactgaacctcctccatccgttccgattcccaaatcattgattcccaaaaatacattgattgccgtaccgctgctggaacctgtcatccttcttccggtaatgggattccttaactgcatatcaactgcccttccattaatactgcaccggtccaccgtatgcagtatatatccatgggctttcagccgctgaataagctgcagggggatttggaccgcatttttcataccgatataatggatatcatcatgtttttccagggcatggattgcctgaggatatactctctctactgaatggtatggatctttcattgcaagaaaggtttgctgtgcatgttttattatctcattcatcccatgattccccgcatgattacaggtattacactggccgccgcttcagggacaaacccaaatgccttctttccgttttctattgattttaaaatctcatcatcatccagtacccttcctaccatggcaaccgtaatacatttatccattccgttcatggcaatcgccatccccaacgcccctccggcccctgtctggcaggaaccaaaataataatccgcctgtccattttttaacgccaatgccgcttgtatgtcctgcatgataaccacttccacctgaccgtttccatacttctctattaactcagcattctcttttttattcaatgctccacctacaacaatcttcattgtacaatacctcacttttcttaaattaacgcaagtcccaataccttaatcagatttgctacaaagcccatagcaattgtaactaccggtcctacagccattggtatcaggaacggctttttggcacacttattcatcatccatacaatcataacaatcatggatccaatatatgacatccccacttcgttcatgattgcccccgaagccgtaaatcctcctaccagcagcgccacctcaagaatttgtgacatcgcattcctgatatggtctcccaattccctaagcgccgggaacttatctaacatattcccgatacttccaagaaaaaatgtctccattgtaataaccgctgctccgcttacaaaggccgctgcacaggtcaccggagtggagaaaccgaaagacgcgcaaagcatccctgctgccacagaaaaataggcacctgccggggaaaatacgcctgttacaatagcggttgtataaaccagggggatataaccgattgcccggatgaatgcaaccagggatgcctgggcaaactcacctttcatctggagaggtcctgatattacatccgttgtcaatacgcattgggaagatgcaactgaaagcaatccacccataattaaaaagtaaatccagtttttcttaatgcggttcacattatctgtaaaaatattcgtcaaatcagctccaatcgcatcctgttttgtcctgactgcaaacataatcatcacaatgcttcctgcaagcatggacattccatctgcattaagagaaagcttgaactccccaatattaaaaaccccaaaatttttaatcaatacatagactgctaatgtgataaccgcagtaattccgccttttttgattccatgctgatatgccacggcaagggacggaaaaatagcaaaggttgctacaacaatatccgctacatttcctatataaggcaggaagtttacaggtaatatggagaaaaaatttgcaatcgatgacataaaggcaactaccataagcccccataccgcaccgattactcctgatacgaccgttcctttgggcgtatcagggcaccatgtccctataatatcccccatcagcaaaaaagtatggattatgatgattcccatagcaatagaatttgtaaaaccaaatccaacaattaatccaaaactcacggcaaaggatgtggcagccagggatttccgatccatcctcccattaaaatactccgcatatacaggccggaatccatcattgtatacagcaacattcttatttgctaaaatagatgacatcgcgccgattccggctgctaataaataatttaacatcataactttcccctttctccgtaatggaattacattaatatattacacagatggaccgtcaaaaagtcggtttccgcttgtgtgaattttagcgttgtacattctaaaattttccggctgactccacacgcctgcggataaacccgttcctcttttactgtgtccaaaacctcccggctgatttgcatctctcctgtatctcctttcttcattctttcccctgccaatgccagatgggtaatcagcatattcagtttatccgaatctgtgcctgcgtgttctgctaaaatcaatcccgccgccatcatacagaattcggacaccccacaggaaatcatccccgcatcctccatgattttaagcctctccttaacttcagccatcctatccatttctttccccctttttttgaatatacatttttttgtactttgaattatatatgaaagagcggacaatgcgctcttcatactcctcaatatagctccctttataattttcgctttgttattttagaaatacggccgtctgatgccgtcccttacctctccaagaatctttagcgtaccctccacgctgatatacttcatcagcagttctgccagattttcattccctttcttaatcaccatcaccgcggtggaaaacatgttactatactgatcctctgccaggaatacaatcttcaggtcatccagacggtggttctcaattatatcatcataattccacacacctgcgtcaatggtcccgtccaaaagtgatgaaatcgtctgttgggtcctgatatccacaagatgaaccttcctatttttaatcaggttcctggtaatacggctctggtccagggaatcctcatcataggccactttcatgccatccatgattccctcagccttctggtctcgaagcaataggatatgcttggacaggaagctgcccgccccaaagttcatcaggcattcaatattccttccgtaggaaatggcgtgctccgccgcgtactgggatacgatggcaaactggtaggtccctgattccaccagctgaatccttcccacagccccccttgcataggccatgttgaatttaagcttctttaactgctcatagatggccgtagcaaacccctcgtaggtctgggaatagggaagaggcatgatgcccatgatttcctgctgcaggcaattctcctgaagcttcacataatccaatgcttctatgtacgttccctgatgtccatggtgtgccagcgtcaccgccccaatgtccttaaggtaattaaaggcgttctgcatggttcccctggatacctggaactcctcctggtagtaagatatgggcgcaatgcggtcccccacatccttggagagcaggttcagggccagcttgctgatggtaacaccttttttttgatataaaacctgactggcatccattttcatactgtaagcccacccctttggtaacctttaaccataaccaacaagaatccttcggtttgaatgtacatttttttgtaccttctatagtgatagaataacactgactgtataaattgtcaagaaatttatcagaaaatatttgcaggcagtcccgttggacctggcatgatttatcctacctcccccagcagcgcgtcaataatcccctgcgccgtcttctcctccacctgcagcgtcagttccggctcgttgatatgctccagataatgcgcatccgaattactgataatcctgcacttatccagatacgggttgtctttcctcagctgatggagcttctttaaatcctttacctcagccgtcttaaacctgctgtccggaggaatgaagcccaggtttgcaatgaggctgttggccgtcttatccacatgggcagggaacatgacacccccgtaagagcgcaccagttcccacagcccgtcaaatgaaatctcagtagcattgattagaaggtttggctctgtcccgcacacctgatcctgctcgttgtatatctgctgcttaccgaatatggcttcattattggggaattgaatcagcttcccatagacataggcatcaaaaccaagcgctgcttccaggttggggaacaggcacaccgcatggacctcctccgaggtattgatctccatgccaggcactgccagcacgccgtattcttcagccgctgccatgaacgcaggacagttgcggcaggtgttatggtcggtcagcgccaccgcctcaagacctttaagggcagccatgcccgcgatattggcgggcgtcatatcatcatccccgcagggcgacaggcaggaatggatatgaaggtcataggtcaggctcatcattgccgggaatcacctgccgcaggggcgttgtccgaagatgcgctgtccccaaagcctccggctggacagccattgcccagcagcccatatatctgaagcgccgcctcaaagataggcatatccgtggacatcactgtaatctcctggtccgccgccttcttctttgccacctcatccaggaccgctccttccgccaggaccacgcaggctgcatccgtcagcgcggccaccgccagtgtgttcatgttccccatgaccgtcacccatgcgcacccggcaggcgcacggcccatggcaatgctcaaaaggtcgcagcagaaaggcgtggtaatctcccgctccaggccgtccccctcattcactacattaaatattccatgttccatcaatccctgtactgtcacggtgaatcctcctcctcgtcctttttatccagcagggacatctcatccgatatcctctgtatatattccttcaggatgcgcagggtctcctggcctcccctgtccccggcatggaggtcgtcagccagtaccgacacttcctcggacagcttgtgcaggttctccctcagatagtagacgcagtccgtctcaatggcattgcccctgacaatatcctctgccagcgccttacaggtaggcgcgccgcaggaaccgcagtccagcccggggaacttcttcatcagccgctccacctggttcagcctggaaaagctctccatcatattgttgcccaggttaaacacaggctcatactcaaccccggtggtccacttgatcagccgctcctcgctgtcatgcatgtggctcctggccaccggcatgtacttgcgcaggcgttttaatttcacctccgccacataagggttctccacggtcagcacaccgcccacacagcctccgttgcatgcattcagctccacgaaccgcaggttggtgaacttttggtcctccatgtcctccagcacccggataacgttctcaatcccgtccgcagccagataattctccgtgaacaggccgctggcctccccgccgctgtgtccccagctgattcctatcttccccgaagtgccgatgacaggataatcctccccggccactgccttcatgcaggccagaagcttgggataaacatcctttatggccagcacatggtccacctggcttttttccgtcccaaggggcgactttacataggtcaccttggacggacatggggaaatgaacatgattccaatcttctccctgggaagccccgtatccttcatggccttctccgccgccaggatacccgccacctccaccggcggattgaggggcaggagatggggaatcaggttggggaaacgcacgcggatcaggcgtacgacggacggacaggcagtactgataagaggcagctgcccctcatgctcggatatgtactgtctggtggcctcgctcaccagttccgctgccgcgctcacctcaaacacatcgtcaaatcccatcttcaccagggcgttgagcacgatgttcacatcatccagattgttgaactggctgtaaagggacggcgccggaagggccaccgtgtattcatactgtttcatcacatccatcttgtcataggtggcaagctttgcatgatgtgggcagaccctgatacattccccgcagtcaatacagaacttattgttaatgctggcttttcctccccgcacccgtatggcctctgtgggacagcgtttgatgcagttgatgcatcccttgcacagggattcgtccagcctcacagaatggtaaaatttatccatatcaacctactcccttgctataccttatatcttcactgtcatggtaatggtggttccctggcccagcctggtgtcaatctccatgtcatccgaatatttcttcatgttgggaagtcccataccggcgccaaagcccagggagcggatttcgtccggagccgtggaatatccggcctgcatggccagttccacatcagggatacctggaccaacgtccgccagtatcatcttaatctgctgaggcgttatctccacggtaatcaatcccccttttgcatggattaccatgttgatttccccctcatacatagcaatggccaccttccggatggcctcagggtcaacacccatctgctttaatttccgtttcacatcgctgcttgcctcacctgccctggtgaaatcatcagctgatatgtcatatgttaaaacaattgcgtcctccataatcggttcccttcattcattatattatactatatggccccgccgtgcagcccggcctcatagagcatgccgcaggcagagaacatcctgtgccccgtggccatgaccaccaggcccctgtcctttgccatctcaagcatggcctcgtccggcttcttccctcttacgaaaataagacacacgatgtccagcatttccgccgtccttatgacctgcggattgcacagtcctgtgagcaggatggagtggtccttggaaaatgccagcacatcgctcatcatatccgagccgcaggccgacctcacttccctgtccagatactcttcccctaccagtacccttgcgcctaaaatgtcccttgcatcccttaccgtcataccttgcctctcctcattgaaaatttgattagttacctcagacaattgtatacaatttaatacaatatagcataccatccatcttgttgattttcaatacaattccgattttttacatgttttttatcgttagatttttcacattaaaggtagatttttttagtgtttcatgataaaatattgatacattgcacaatgtacaacctatgaggaggtaataaaaagatggcttgcaaaaaacaaaccgttccctttgcgggaacacctgagcaggaggcagaactgaaatcagtgattgcccagcttaaggaccagcctggtgccctgatgccggtaatgcagaaggcccaggacatttatggttatcttcctatcgaagtgcagaccatgatatctgacgaaatgggtattccgctggaaaaagtctacggagtatccacattttatgcccagttcgctctacagccaaagggcaagtacaaggtatctgtctgtctcggtacagcatgttacgttaaaggttccggcgaaatcttcagcaaactggaagaattgttgggcatcaccaatggtgaatgcacagcagatggcaaattctccctggattcctgtcggtgtgtcggcgcctgcggacttgctcccgtcatgatgatcaacggcgaggtatacggacgtcttacggtggacgatatacccggcatcttagcaaagtacaattaagcctatgatgacagagatttccctgaatgtactggatgtatcagagaattccacacgggcaggcgcttccctcgttaccattctggtcacagctgacacggccgatgacaagctgaccattgtcatagcggatgacggttgcggaatgacagaggaacaggtggcccatgtaacggaccctttctttaccaccaggaccacaagaaaagtaggacttgggattccatttttcaaatacgccgctgaaagtacgggcggcaacttccatattgaatcggaaccaggtaagggaaccaccgtaacagcagtcttcggactgtcccacatagacaggatgcccctgggtgatatgaatctgaccatacataacctgattgtgtaccatcctgatacagatttcgtctatacatatacgtataatgatgcatcattcacgctggatacccgggaaatgcgggagattcttggaggaatccccttaaatgcccccgagatatccgattacatactggaatatctgaaagagaatcaacgggaaactgacggcggtgtccagctctaaaccggacacacgtcccacaaccatgtaagtgctcataatgagccactcataattaggaggataatcgcatgaaaactcttgctgaattacaggcaatcagagagaaaatgcagagccaggtcaacctgcgcgccgaggaccacaaccatacacgcgtggtagtaggcatggctacctgcggtattgcagccggtgcaagaccggttctgaatacactggcacaggaagtccagtccagaggactgactgacaaaatttccgtaacacagacaggctgtatcggcttatgccagtacgagccgatcgtggaggtaatcgagccaggcaaagataagattacatacgttaaaatgaaccctgacaaagcccttgaggtgatggagcgccatttaatcggcggccacccggtagagaagtacaccatgggcgcagcaggccttaaataataaaggaggaaagtaccatgtatcgttcacacgtcttagtatgcggcggcaccggctgtacttcctctggaagtccaaaaatcatggaagccctgcacaatgaaatcaagaaacagggactggaagaggaagtggctgttgttgagacaggctgccacggactctgcgctttaggtcccattatgatcgtatatccggatgccaccttctattccatggtgcagccaaatgatataccggagattgtatccgagcacctgttaaagggccgtgtggtaacacgtcttctttaccaggaaaccgtcagccctaccggcggcatcaaggcattaagggatactgatttctacaagaaacagcaccgtatcgcactgcgcaactgcggtgtcatcaaccctgagaacatcgaggagtacatcggcaccggcggctaccaggcccttggtaaggttttaacggaaatgactcctgacgatgtaatccagaccctgcttgacgccggtcttcgcggccgcggcggcgcaggcttcccaaccggattaaagtggaaactgtgtaagcagaatgacgctgaccagaagtatgtctgttgtaatgcggacgagggcgacccaggcgcattcatggaccgttccgttctggaaggcgaccctcatgcgctccttgaggcaatggccattgccggttatgcaatcggctccaaccagggttatgtctatgtgcgtgcagagtacccaatcgcagtggaccgtctgaacatcgccatcaagcaggcacgtgagatggagctgttaggcaagaacattttcggaaccggatttgactttgatgtggatatccgtctgggcgcaggcgcattcgtgtgcggcgaggaaaccgccctcatgacatccattgaaggcaagcgcggcgagccaaggccaaggcctccgttcccagcacagaagggcctgtttggcaagccaagtatcttaaacaacgttgagacttatgcaaacattcctcagatcatcctcaacggacctgagtggtttgcttccatgggtaccgagaaatcaaagggtaccaaagtattcgccctgggcggcaagatcaacaacacaggtcttgtggaagttcccatgggaaccacactgcgcacggtcatcgatgaaatcggcggcggcattccaaacggcaagaagtttaaggctgcccagaccggcggtccttccggcggatgtatcccggctgagcacttcgatatccccattgactatgacaacctgctctccatcggttccatgatgggttccggcggcctgattgtcatggatgaagatgactgtatggtggatattgccaagttcttcctggaattcacggttgaggaatcctgcggcaagtgtactgcatgccgtatcggaaccaagcgtatgctggagatcctggagaagattaccaagggcactgccgagatggaggaccttgataagctggaggaactctgccactacgtaaaggccaactccctgtgtggtctgggccagaccgctcccaaccctgtactgtccacccttcatttcttccgtgacgagtacgaggcacatatcaaggaaagacgctgtccggccggcgtatgtaaggcgcttctgtcttatgtcattgaccgcgacaagtgccgcggatgtaccctgtgcgcacgtacctgtcctgcaggtgcaatcgtgggaagcgttaagaatccgcacgttatcgaccttaacaagtgtatcaagtgcggcgcctgtatggaaaaatgtaagtttggcgcaatctacaagaaataataagggagggaatagacgatggagacaattaatcttaaaatcaacggcattgcagtcaccgctcccaagggatccactatcctggaggcagcaagactggcacatatcgagattcctactctgtgtttcttgaaggagatcaacgaaatcggtgcctgccgtatctgtattgtagaattaaagaatggaaaactggtaacttcctgcgtatacccggttgaggaaggcatggaagtatttaccaatacaccaaaggtcctggattccaggaagaagaccttacagctcctgttatccaatcacaaccgctcctgcttatcctgtgtgcgcagcggacactgcgagcttcaggaactggcccatgaactgggagttgaggacgaggctttctatgacggtgaaaagacaccctctgagattgactactccgctgcccacatgatccgtgacaacagcaaatgtatcctgtgccgccgctgtgtggccgtgtgcgaccagatacagggcattggcgtgattggcgccaaccaccgcgggtttgcaactgatatcggctccgcatttgagatgggcctgggtgaaacctcctgcgtttcctgcggacagtgtatcgccgtatgtcctacgggcgccctaacagaaaaggattacaccggggatgtattcgcggcaatcgccgacccgtccaagcatgtaatcgtacagacagctcctgccgtacgtgcaggactgggagaggaattcggcctgccaatcggtaccgatgtggagggcaagatggctgccgcactgcgccgccttggctttgataaggtatttgacaccaatttctccgctgacttaaccatcatggaagaagcccatgagttcctggaccgcgtacagaatggcggcgtgcttccgatgattacttcctgttcaccaggctgggttaagtactgcgagcactatttcccggatatgaccgagaacctttccacctgtaagtctcctcagcagatgtttggcgccatcgccaaatcctactatgccgagaaggccggcatcgaccctaaggacatcgtaagcgtaagcgtcatgccatgtactgccaagaagtttgagattggacgtgaggaccaggatgccaacggcgtaccggatgtggacatttccatcaccaccagggagctggcccgcatgataaagaaagccggcatcaggttcttagaccttcccgatgagaagtttgacgatcccctgggtcttggcacgggcgcggccgttatcttcggcgcaaccggaggcgtcatggaggcagcactgaggacagccgttgagacactgaccggcgaagaactgcctaagctggatttcgaggaagtccgcggcacaaagggcatcaaggaagccacctacaatgtagccggcatggatgtgaaggttgctgttgcttccggccttggcaatgcaaaagagctgcttgaaaaggtaaaatccggcgaagcagactaccacttcatcgaaatcatgggatgcccgggcggctgtgtaaacggcggcggacagccccagcagccaggacatgtgcgcaacacgacagatatccgcggcctgcgtgcaaaggtcctttataacatcgactccgccaacccaatccgtaagtcccatgagaatcctgcaatcaaggaactctatgcagcttacctgggcgagcctggaagcgaggtagcacaccacctccttcacaccacttatgtgaagaggaccatcaataagcagtttaccagggaagtacccaacattgccatagaggttggagattattaaggttttttgcaagcaatattaatatacagaacagcggattgcaggcttgcccctgcatccgctgttttggcgtttttccttatatatctacctggcccgccatccaaacagtccgtccatcacactccatcataccaattcattatacttcccgcgcttcacataatgggtgtgcagcaggtgatgggacaggtgcccgttgggcgttcccaggtaatcgttatacagcttcatcaaatccgggttctcatgggatttgcgcagtaccttgcgttcatcttcgctgtacagggccttggcgcgcttctcgcggtagttctcctcactgcagcgtggctggccgcctccgttgatgcatccgccgggacatcccataacctcgatgaaatgataaggggaggttccctccgccacttccttcatcagcatggatgccccctccaggccgctggttactgctacattcacagtcacccctttcagatgtccatactcaggaagcgtctcttctatcgtaatggaggctgtcttcacctggtccagtccaacgattggcgttacatggagtttttcaaacggcagttcatttccggtcaccacttcgtataccgtgcgcagggccgcctccatcacgcctccggttacgccgaaaatgtcggctgctcctgttcccaggccaagaggcgcgtcaaactcaccttctggaaggttcacaaagtcgataccggctgtcttgatcatcctggccagctcccttgtggtcaggaccgcgtccacgtcgcgctgtccgtccacttccatctccggacgctggatctcgtatttcttggccgtacacggcatcacggacaccacgaacatatccttgggggccgtgcctgtacgctccgcgtaaaatgtcttcaccacggctcccatcatggtatgggggcttttacagctggacaggtggtccagttcatccgggaactggtgctcaatgtgtttgatccatcccggcgaacagcttgtaatcatgggaagggccgtattgaccccatggccgtcctctccctgcgccccatcgcccttaagcactgcatttaaacgtcccaacagttccgttccctcctccagtatggtcaggtcggctgagaacagggtgtcaaatacatcgtcaaaaccgatttcatgaagggcggatgccattttcccggtgacgggggtgcccaccggaaggccgaattcctcgcccagggccgcgcgcacggccggagccacctggacaaccacgcgcttatccgggtcagccagggcgcgccatacaggtgtgaggccgtccgtctccttcaatgccccggtgggacagacaaccgtacactgaccgcacattgcgcaggccgtggaattaagcggcaggcccatggccgggctgaccactgtgtcgaatcccctgttctgggcttcaatggcccctaccttctgtatctgcttacacacggtgacacacctgcggcacaggacacatttgctggtatctcttgtgatggacggggaaatgtccacatggggtttggtcatggcgccttcaaagcggctttcggccacgcccagttcatatcccaggtcctgaagttcgcagttggtattcctgctgcagttcaggcagtccttgggatggttggacaggagcagctcatagagcaccttcctggcttccagaaccttgggggaatgggtccttatgaccattccttcccgtacctttgccatacaggatgcctgaaggttcttcatgccctccacttccaccacgcagatacggcaggagccgtactggtggacatgtttcatatgacagagactgggaatcctgattcccacggattctgccgcttccatgatggtggagccttccgctgcctccaccggttttccatttatggttatatgtatcatacaatcatttcctcctctccctatctccggtcacagtgaagacatctcagggcctcgcccatagcatccagtttatggtagccgcagttcacttccttaaagttgtctttccgctcttccacggacaggcatctggtggggaaccgtttatgcggctcgcttacttctatgtcaatctcaggaatctcgaaccattcgcccatgttaagttccccggtgccgcccacgtatttatcaatcttaccggcggccttcttgccgtccgcaatggcctggatgaccacgttggcgccccacgggcttacatccccgcctgcgaatacgccttcctcgcctgtctcggatgtaaagcggccaatagccagcttgccgttcttctccacttccacattggtggtcctgtatgcctgatggtccacatcctggttgatggccgtgacgatgccgtcacactccaggaagaaatcagaatccgggatatgtgccgtacgcctgcggccgtccttcccataatctgtttctttcctgcgcacaaggtggattccgtttaccttgccgccagccccgaggaactcgaccggggatgccatggtaatcagcttcacgccctcctccctggcctcggcgatttcgtccctgcctgccggcatgtctttctcagacctgcggtaaatcacggtcacatcggtgctgcccagacggattgcggtcctggccacgtccatggccgtgcttccgcctccgattaccaccagcttattgggaacatccatatcacgttttaaaccaatcctcttaaggaatccaaggccgctctccacgccctttaaatcctcacccggtacatccagaagtctggatacctgtgttccggatgcaatatataccgcatcggactgcttcttcatatcctcgaaggaaatatcggttccgatcttggtgttcagatggatttccacaccgctcatctcaatggcatggatttccttctgaagcactgccttaggcaaacggtattcagggataccccagtacagcacgcctcctgccacggattcagcctcatatacatggacctcatggcccagattagccagataataggcacaggagagtccggacggacctgccccgataatggatatgcgttttcctgtggctggtttcggctctatcagagggatattgtactcatcgcgcagcgcgtaatccccgataaagcgtttcacggagcagattgccagaggctcatccacctgggaacggcggcagtggtcctcacacggatgtgtgcagacacgtccgcagacagccgggaacggattatcctggcggatcaggcggtaagcatcgtcaatcttaccagctgccagcatggacatatagccgggaatgaatacattggccggacatgcgttgcggcagggcgaggtctgaagctctgcgcacacgcctgcgctgcagtgtttttcgtaaatatgggcctcatactcactgcggaaatacctcagggtggacaggaccggattcggagcggtctgtccaagcccgcacatggctgtctgctgtatggtcttagccagttcttccagcaggtccaggtccccgggttctcccttgccctctgtaatccgctccaggatttccagcatgcgcctggtgccgttgcggcagggaagacattttccgcaggactcgtcacagatgaagtccatgaaatacctggccgtatccaccatgcatgtgtcctcattcatgacaataaggccgccggaccccatgatggccccaagcttggaaagggactcatagtcaacggatgtattcaggtgttccctggtaaggcacccgccggagggaccgccggactggatggctttgaaccgcttgccgccaatgatcccgccgccaatcctgtatatgatgtcgcccaggaccgtacccatggggacctcgatgattcccgcattgacaatatccccggccagtgcaaatacctttgtgccggcgctcttttccgtgccgaatccatgataccacccggaaccgttcaggatgatgggagccacattggccagtgtctccacgttattgatgatggtggggctttcaaacaggcccttttcaaatgggaacggaggtttctgccttggctctcccctctttccctcaatggatgccagcagggaggtttcctcaccgcagacaaacgcgcctgcgccgatacggatttccagatcaaaggagaagccgcttcccatgatatcctcacccagtatcccggccttcctggcctggtcaatggcattgcccagacgctccaccgcaatcggatactccgcgcgcacatacacatatcccttggacgccccgattgcgtatcctcccagcatcatgccctcgataatgctgtgggggtcgccttccaggatgcttctgtccatgaatgcgccgggatcgccttcatccgcattacagaccatgaacttcctgccgtcctctgaaactgccttaaggcctgcctcccacttaacgcctgtggggaaacctgcaccgccccggcccctgagcccggaagccttcatctcatccaccacatcctggggcgtcatgccgcacagtgcttttgcaagggcgccatatccgtccctggatatgtatgcctcaagggaggcatactccatatggccgcagttcctgagtgctatgcgcacctggccctggaagaaatcaatgtcctccatcctgggaacatatttgcctgtctcctcgttaaaatatgtaaactcctcgcagatctcatccttaagaaggtgtcttgccacaacctgttccaccttatcaggagtcattttcgtataaaaaaccccctccggctccaccaggatgaccgggcccatggcacatgtgcccatacatccggtcaccatgacctggacttcaccggacagctggaagttttccactgccttaaccaatgcgtcccgcacttccccgcagttagacgagatacatcccgctccgccgcacaccagcacctggcgcctgtaggattccttccgggccaggtattcttcttttatccttaacaggtcttcctgtctcttcacttccatcactgctgtccctcctcttcatagtagcgctccagaatctgctccagtttgtcaggattgacctgcttatacacctggtcgtcaatggacatggccggcgccagtccgcatgctccgatacagcgtgccacctcaaaggtgaacttcctgtcagctgtggtctccccgatttccacatccagcagctccttaatccgttccacgattttcttaccgccccgcacatagcaggccgtgccaagacagacacggatggtgtgctcccctctgggctgtgtggagaagaaggaataaaatgtcactaccccggacacctccgccagcgggacctcaagcgcgtccgctatcaccttctgtacttcaagaggcagatatccatatattccctgcgccatgtgaaggacctgtatcaggcttccctccctgcccctatactctgccgccagttcaccaatccgttttaacagcgcttcctcactgtggtcacagcagcacgtatgcgtgtgttcacccataactttacctcctttattttaccgcttttgttttccatttgtattaagcgttgcgtgctggcctggcaggcggctgcagtccgcctgatggctccctcatcgcaggttctcccatattgggaagaatgtattgtgaaaaattatacaaagaaatggcgggaacaaccttaccggctgctcccgccaaaaagaccctgtataactttttccgactttttaaaaatgtcctgcctgccctgccgcaggcggatattccctctcactaaatccatcgcgcacctcaattgattaaaaatatctgattcactaatatatacaatcagttgccgttcagccatccaatcttttattattgtacctaaaaaattttgttatctcaaaataattttgtatatttttgatgatatcatagaagattgtacttgtcaatatacaattaaatttttcacaagcaagtatatacgctgtattttatatttttttcagtttattctgaattttttcggtcgatttctgtcgtttttctgaatcgtattttcattttttccaacatatggtacaatatcgttaacaaaatctttatacttttttcacagaaaggagcttctatgtttgaccttgattttatccttaaagcactgtccattcttgttcctgtcctgttggtcatcatcatcataacccagggctatgtaaaggcgccgccggatcacgccttcatcatctccggcctgcgcaagcagccccgggtccttatcggacgggcgggcatcaagatcccattctttgagcagatggataaattataccttggacagataaccgttgacattaagacggacgaatacatccccaccaacgacttcatcaatgtcatggtggacgcggttgccaaggtccgggttgccgatgatgacgggcggatgaaactggccatgaggaacttcctgaacaaggaaccggcaaagattgcggccgacctccaggattccctccagggcaatatgcgtgagatcatcggcacccttaccctgagggccatcaatacggaccgtgattccttctcagaccaggtaatgattaaggcttccaaggacatggagaagctgggcatcgacatcctttcctgtaatatccagaatgtcacggatgaacacggactgattcaggaccttggtatggataacacctccaagatccgcaaggacgcatccattgcaaaggcggaggcggaaagggatatcgccattgcccaggctgcggcggataacgctgccaatgacgccagggtaatcgccgagacagagattgcccagaagaacaacgagctggccattaagaaggccgaactccagaaggcgtctgacaccaagaaggcggaggcggacgctgcttacgaaatccagaagcaggaacagcagaaaaccatccagaccgccacggtcaatgcccagattgccagggctgagcgcgaggcggaactgcgcaagcaggaagtactggttcagcagcaggcgctggaagccgagattaacaagaaagcggatgccgaccgttatgccatcgagcaggcggctgcagccggactgaccaaacgccagcgtgaggcggaagccaagaagtacgagcaggagcaggaagccctggccaagaaggcccaggccgatgcggagcagtatgagcgcgagaaagacgcggaggcccagaaagccatagcagaagcacagaagtactccatggtccaggaggcagaaggtatccgcgccaagggtgaggcggaagccacggccatccgtgcaaaggcgctggctgaggccgaaggtatggagaaaaaggccgaggcctaccagaagtacaacaaggccgccatggctgagatgatgatccaggtgcttcctgaaatcgcaggcaggattgctgaacctctgtcccagattgataagattaccatcatcggcagcagcggtgactcagataatggtatcggcacggtcgccggtaatgtaccggttgtcatggcaaagcttttcgaatccatgaaggaaacaaccggagtggacctggcggaaatcatgaaggcggatacatacgatgccaaggttaccaggaacgtcaacctgaccggagcgccggatatcgtactgggtgccaatgctgcatctgattccgtacagcctgaaacataggattacatgatgtcctggattgaagtcatataaaaagattgaagtcataaaaaaacaagatggtgctgcagaaccagcttttgccggaactgcagcaccacctttttatctgtctggctggtcagtgaaacgtccagcttcatcctcttctgtttcagtccactctccggtaatgatccggttgtcctccgggttccagaacgtttcataattgttgttttcagacgggcttatgtctcccgcttcctggttctcctccggatcgcaggggctctccatccctggattttcctcctgcgcattttccttccagcgtatggttacccggaacaggtcgtcttccacttcaaccatcatggtgccgccctggacctccacgaagctccttgcaatggcaaggccaaggcctgagccttctgtgttgcgggctgaatccccgcgcacgaaccgctccgtcagttcctccggcgatacattcagctcctgggccgatacattgcgcatggatatattcacatatccttccggttcccgtgccacctggatataggccctggtgcccggcatgccatactttgcgatattaaccagcaggttctcaaaaatacggtaggtcttctggctgtccaggtacagcactacccgcccctcaggcaggttgaaccggaactcaatcccgctggcagtcattttgtctgacagttcaaaccgcacctgctttaacaggctgatgatatccacattttccgggtgcagtgtcacggtgccgctgctggccttgcttacctcaaacaggtcttcgatgagcaccttcagacgcatggatttctggtccaggacctggatataggaactgcgctcttcctctgtaacattttcctgcttcagcaggttcacataggtgatgatggctgtcagcggcgtcttcaggtcatgggacacatttgtaatcagttctgattttgtccgttcgcttttcacttcctgggcaaccgcctttttaaatccattctggattttggacagctgttccttaaatggattgaatatgcccagatcttcttctatctccacattcaggtcgccttccgccatctggttgataccgtccagcaggatcctgtatttcttctgcatctgtccccaatatttattcagcatgaagaacagcacgcatgagtagatgaccaatgcgccgattccccagaaccagagacaggatatgagggtcagtataatgaagttgccgatgaccgccttgcctaaaatcctggtggaacggctctcccagtccgtttcattgaatacattaagcgcattgcagcaccagcgcttgatgaaccgcaggaaccttccaagccaggtgcgttccttgaaatagcgccatggccccattgagaagattgcgcggtaacacatgattccccagcagaaaagcccgtataccactgcccagaacagcaggttgatgacaagcaccgctatatcagcgctccaggaaaggaatccggccctgaggatttcctgtttcaaggttccgtccagggtggcggctatgaggcttgacggtataccgccttcccccattatactcatccatcccacgcctataaggctcaggggttcaaaagacagacggcagagcgcgcttttacccaggcggaaggaacggaccgcgggcagggcaagggcaagaaccatgaggatggccatcatcccgccagctaccgtatagtaaccgcctccgtacagcagcgcccgtccgttaagcatcgtgttgtccgatgtactgtaggaactgccggtaaatgtttccggcacacagcggaacatgatttttatattccttggcccggtgaactgcatgccgctgtaccgatagctgtcagacaggcggacggccaggggatcgtagaattcgaaccggcccatggcctggaggatcttggacgcatcctgctcatccccggtaaagcccgacacctttaggctgcctgtggaagtaaattctaccgtgaaaccgacttcctttttagcggaatccaatggcgtacggaaaaattccccgggcttatttacattgcttctctgaaagcctccgttttcatctattacagcatagaaaagagaggagttatatctctggtaataccgctcccagtccttacccagggaatccatcatggactgcagctcctggtaataatccagattaaactcagagtccacatagtcctgggcgcccatggccacctcataattttccccatcttccatgtcggaatcctggattatgacatggctggatgccactccgtattcttcttccctgagcgtcctgattttctcatccaggccagggaggaaggtctgtgaataagagagcacgccgccctcttcctcctgtttctgctggtgccatatctcatagctgaaattcatgacctgggtcgccaggtcgccgtaatcacttccctgttcctgtatccgcacggtcctgtcagaaatatactcctctgattttgccttcatatacggatacagcccaatggttgccgccgataaggccagaaccgtcagtacaattatcaatacgccgattttatggttgtttttcaatcttgtatccaactccccacaccacctttacatatttgggctccctgggattcacttcaatcttttccctcaggttacggatgtgtaccatgaccgtatccgtgttaatcgccctctcattccaaacccgttcatatatctcctcagcggggaatacacgtcccgggttctgtatcagtaacaatagaatcttgaactcaatgggagtcacctttaccggtttgtcatctaccatgacctccactgtctcctcattgacctccaggcctcccagcctgtgaatccttggatcctcagcctgtttggaactcagtctgtctaaaaacctgtggtagcgcctcagatgtgagttaaccctggccagaagctccatgggcgtaaacggctttgtgatgtaatcatccgcccccatgttcagtcccagtatcttgtcgacttcctctgattttgctgacaggaaaataacaggaaaatcatacttttccctgagcttggcggtcatggtgatcccatccatcttcggcatcatcacatccacgatggcaaggtcaatctcgttgtcctccaatgccttaagcccttccaatccgtcagctgcctggaataccacatatccctggctctttaaaaatatctcaacgccctctctgatttctttatcatcctctaccagcagaatccggtccccactcatgtacatttcctccttgtgcatataatcctaacaactaaatcaaaatttaacctgcaaaaaatataaaagaatttctaaagtcttattgtagcattcctaaggataatgttcaacggggggccggacgtgtttggaaaaatcattccatcctccccctgtaatgcaaaatacgcaatttgaaagactttgttatttatttaattaaattgacaaatacttctgccaatgatatggtttttatattcaataataataattactgttatttatttagcaaagaaacggtaaaggaggtatttcattgagtacatatgttataacaggcggtaccacaggcatcggcgctgcaacccgcaagctgcttcaggcacagggacacgaggtgttcaatattgactttaaaggcggcgactacctggccgacctttccacgcaggagggccgccagggcgccattgacgaggttttcaggcgataccccgatgggattgacgtcctgatctgcaacgcaggcgtgggacccacggcgccgccccagatgatattcgcactgaactttttcgcaagcgtgcggattgcggaagccctgcgccccttgttaaagaaaaaacgcggaaactgtgtcatcacctcatccaactccattaccaacatgaccgtgcgcatggactgggtggatatgctgtccaatgtaatggacgaggaacggatcctggaatttgtcaaggacatcccccgcacccagactgcttcctgctatagctcatccaagcacgctttggcgcgctgggtccgccgtatatccccatcctgggcagtggacgggctgcgcatcaactccgttgccccgggcaacaccaccactcccatgacccagaacatgaccgatgcccagatggacgccgccttattgattcccattccgacccgctacggcagaaaggaattcctggacgcggaagagattgccaacggcatcgtcttccttgcatcccccatggccagcggcattaacggcgtcatcctgttcgtggacggaggcattgacgcactgctgcgctcagaacgtttctaattgtaagtgaggaggataattatatgacaatattagaacaatacattgactgtatgcagaagggggatgaaaccgccctggctgatttattcaatgaatacggggtccttcacgactcttccgtatacaaggccggcatggataccatccacctggaaggcaggatggccgtggaaatgatgttccaccacaaattcggttttaacggcggacccttcccaatccacagcgtgaaatacgtggatgacaataccgtatggtacttcatcacctatcatgagcacgttgtcccggtgaccgcgtttctttcagaggtggatgaaaaggggaagattaagaggctgaatatttatccgctgtaggcgggaatccatgggcaggggacagacgtaatacacgtgtcccctgccccggttcagtcagaagccggattccatttccattttattttgttattatatctcatttctgtaccattttcttaacggttccctccaggtccagaaggaaataaagtccgtcctggcacatgtagtattctttttccatccagagtcctgtctcggatttctccgggcctttaatctggttgtccggggttgcttctgtcaggaacggttcctggtccgtaaggattccgaagctgtatttttgatattgaaggatgacgatgatattcttttgttcttccccttccttaggaagcccaggctcctccagatacgcaattgggacaatggttcccttgtagttgcagaccccggcaaaatacgcgggcaggcaggggatgggggacatcaccatgtccttgcatatctccttgatataggggaattcgattgcgcacctcctgttccttccgggtatgcagagtacggtcttagtgttttctgacggcatttttcccctccttctggtacaggtcaatgattatctccgtgtccagggccgcacagacatggccgcttcccatgatactgcagccgcagattccagtccttcccctgaatccgtttccaaataatggcggaagcgccttgattacaatccgcttctgtccgtaaatggaatccatgatgatgcacccttcctgttcagccccttttacgtaaacaagtacagcccgttccggtgtgtgccccggaagggaatagaagcatcgcaggtccacaaggggcaccagcctgtcctcatacaggatataatcccgcccgctgatttcacgggtcgtatcctttaccgtgttgtagtcaaggaaacggtatacatgacgggcaggcagggaaaagcggtagtcccccaccttaaacctgacgcattccatggaggccaggtttaaggggaccgcaatggtaaaggcgcttccctcgccttttttgcttttgatgtacaggttgccgcccacctcgtccatgatgttcttgaccacgtccaatcccactccgcggccggaatattcggttactgtttcattggttgagaaaccgggtaccagcaggacgtccctgattttctggaagtcactttcttcctggcttccgtccatcaggctcttttcccttgccttttcccggaccttatcctcatcaattccctgtccgtcatcgctgatggtcagccgcagttcacctgccgtattctcagccgtaaaggttatcttaccttttctgtcctttccggctgcctccctctgctcaggaggttctatcccgtgatccacggcattgcgcacaatatgcagaagcgcttccgacacatagtccacaacgcttttatcagcttccacatccgcacagcgcacgaccagctctgcttcctttttctggtcgcggcagatgtcccgcagggcccgcttcagttttggcagtatcctggcaaccggcacaagccgcatttccatgacggagcgttcaatctggctgaccagaaggctgatctgatgggccgtcccactttcaatttcatccagcccgcgcctgccaagttctgtctccaaagtctgcatatgaagcagcagctccgctgcaatgttctgtaggaggtccagacgttcggtccgcacctccatgaaatccccctccagggattccttatccccgttttcctgtgtctccctctcttccccatccttctgcttcacggtatccgcggcgcggctgtccgccaccaccctgcaccgtgccacgaaaagtcctttttccagggtatccaggaccgcttccttatcattggcctcaaagcggatgtataggccgtgcttcccgatatattccgcgctttcccccggactttccaggttctcaggataggtctcaatcagggaacagagaccggatatggaccggaccagcatgaatgcccggatgttctccatacggcatccttcctccagggtcacattggccacgataccgctttttgattggaatatctccggcagctggggcagttcctccgtttcttccttccccgccgattcctgtaacacttcttcctgctgtatattatttaataggttcagaaatgcatcggtctttttttctatatccgatgtatcccgtggggaatattccgcccgggtcatctgttccagctcctgctcaataaaatcagaggcggaaaacagcaggtcaaacagactggaatccggggcttccagccgttccggatgctccctgtaataggagaacagatcctccagcttatgggccatggaggacagacctccaagccccatcatggcagaggaactttttattgtatgcatgaccctgaaaatgctgcgaatatcatcctcgccaaagtacccggtccgttcagcttctaaaaggatatctgccatctggctgttgagctgccttgtctcaagaagataaacctccagcatttcccgggcatccgaatcaaaatatcccataatatgctccatccattataaatcctcaaaccagacgctctggttcttaccgttccttttgccgtaatacaatgctttatccgcacagcttatgcattcttccaacgcctcatgcggtttgaatacatgaagccccagggttatggtgcaggaaaaccactcttttccataagggaccacaaactgttccacctgcctgcggattctttcacagatgtcaaatgcctcatccaccgtgacattgaacaggatgatgaggaattcctccccgccccagcggaccaccctgtgttcgcggcagttgctttccaggatattggcaatgcacacaagggccatatcccctgcatcatggccatatgtatcatttacgcgcttaaaatcatcaatgtccaccatggcaaacacggtttccaccgcctcttttccacagcttcgcatgtcctccagtaaatcgcccacaacatagcggcggttatacagtcctgtaagcccatccctgtaagccatgtagttcagtttctccatgctgttgcgcagctccctgttctggcggtccagttcgtccttctgctttttctgaagaaggtgggcgtggatcctggactgcagctccgccttcacaaatggtttcttgatataatcacatgcacccacagagaatcccctgaccacatcctcatcactggatttggaggtcaggaaaataatgaccgcatttttctggtccgcctccttaagtgtaccgtaaagctcgtaaccgtctgcatccggcagtaccacatctaaaaggattaaatccggctgatgctgttttatctgctccactgcctcctggcccgtatgcgcttcacagatattgatgtcttcctccttcagtgccagtcttatctgattgcagattaaaaggctgtcatccacaatcagcacggtctgtctgccgtcattttccatatacataaacctacctcctggttttaaagcatgatatccgcatgccttaccgtacttattttaagcgtcccatcccctgcgtgaaaggaaatggtcctgccatagtttcttcctgtgtcctgggccgtcagcttaatgccctcctgctccaggctgcatcttactgcctccacattcctctggccgatatccatggtattcccggatgtttcaaacatcctggcgcctcctgcaatcttggctgtcatcctgcccttcctggctccgtggcgctccatttcccgtatcagttcacgtacgccctggtccgcaaacttatacaggttcgttttatctgcagcatactccgtgcagggcaggatgacatgggccatgcccgctatgtgttcctgccagtcataaaggcagacccccacacaggacccaagggcataagaaaccagcacctggtctccttttgcaatttttccttctgcaatccctacaataatcttatccatgtcattactccctgagcctatgcagcattttacccaaatcttcctgctccggaagaaacaggattgttcccttaaatgccctgcccgacatatggaacatattctctatcagcagtatgtcatcgcccgcaatcacccacctggtcatgggatagctgaggatggcgccgcccatatcaatgcacagttccgggaccgatacatccatttccatgttcatgaaccgggacaaggccctgatataagaaccgcacatgatattacccatctcgcagataagcgaccgctccatgtcatccaatgccatgaggtcccgctctccctgtccaaggattgcgctgagcactgattttgtaaatgtttcgctgagcaggaaaaggaagattcctttcagctgtccggtgacctccacaaggattcctgtctggggctcatcgggcctttccaatatatcatatacatcctggtatcccatgatcctcaggaccggcacctcaagttcgacgggctgctccatcatctgtgcaagggaggttaccgcgttgcctgcgcccacattgccgatttccctcagtatatcccttgatatctcgtccatctccctgtaatggtccattatcatacctctctttatcattcctataattcgaacttccctaccagttccttaagaatctgggcctgggctgaaagttcttcgcttgcggcagcgctttcttccgaggttgcggaattcccctggacaatctctgagataagctccacgctcttccggacctgtgcaatggcctctgcctgctgtacggacacctctgaaatctgatccattttccggttcaccctgcgggcgccttccacagattcctttaaggtgcgggccgttatgttcaccgcgtccacgccgttcctggccgcatccgaattcttctcaaccagttccgccgtaagcttggatgcccctgctgcctttgtcgccaggcgccgtacttcctctgccaccacggcaaagcccctgcctgcctcccctgccctcgcagcctccacagaagcattgagcgccaatatattagtctgaaaagcgatatcttcaatctggcttactatctctgtaatctctcccgagttcttctttacctgtccgatggattccatcagggctgccatctgggcatcgcaggcctccagtccatgtcccacggaagctgcaagctggcttgaagccactgcactgtccgcattctgcttcacactgtctgcaatctcgttgatgctcactgccagttcctccacggaaccagcctgttccgaagccccctgggccagggcctgggcattgttggacacctgctcagcgctcagtgatacctgctcagcgctgttgttgatctgctgcagggactggcgcagcaggcctccgatttccttaaggccattgccgatggcaacaaagtcccccttaaattccgttgacgccttataacccagctggccgttcccaagagctgtcaggccccgctccacctcggaaatataaccggacagtgccctggccgtgtggcgtatatcatctgccagctgtccaagttcatccttggaccggtacttaaggtcaatgtccagcctgccgttggatatggtattggccgccttcttaacctcattgacgggacggacaatattccttgttatgagtatgcagacaaaaaccgtaatcactatacaaaccagggacagcgttatgagcatgaacatgatatgatggttgtcctcatgtcctgccgccaggctgttttctgcatcggcaacggaaatatccacgacatcgttgaggacgttcctcacgatgttagcctgcggaagatacctgcttatatatgcatccaggacttcctcatcctttcctgattccagaagcgccatcacggcttcccgctcaacggacagcttgtcaaactccgcctgaagttcctttaccttctccggagcgctgatataaccggtggtcagttccgccaacgacacttcctcgctggcaatcagctcctttgtcttattcagatattccttttcatccaccatatcctccgtggctgacagtacggctatattccgttccactgcccggaggtttgctatcatcctaagggaagactgcacattggcaaactggttattgtacagggtttccatccgtgatgatatggtctcgatgttagacagcgccatggcaaccgtgatgatatataagaggatgataagcatgaatgccaaaatcattttctttcctgtcttatagttcctgaaccgttctctcatcttatgcttccccacattcttattgttttaagtagcagttcacaaccttgctgaattcttccggcttaaacggcttcactataaaatccaatgcccctgcaagcaccgccttctggatcatcgtatcctgtccgaccgcggaacacatgataacctttgcccccggatccatgcctatcatttcctcaagcacctcaagccccgactttccgggcatggtaatgtcaagcagcaccaggtcagggtggatcctgcgaaacaggtcaagggcctgctccccatcctgggcttccgccacatcctcatatccgttttgtttcaggatcctgcggatcatacttctcatgaacattgcgtcatccactatcagaatttttttatccatctaaccaccctctgtttctaccttgtttttatatttttgtaaaccgcgggatatacggctttcagccctgtctcatccgctgccagcagttccgcgtgccctaccagcaggtatccgcccggcttcaggcactgttccagctgccgtataagccgtcccctggactgcctgtcaaaataaatcatcacattccggcacaatatcaggtcatacttatccgctcccggaggctgctccatcaggttatgccgcctgaaacggatattataccggagccgttcatccacggcaaatgtattcccgtcccgcacatggcagtatttgcgctgccatggtccgggcaggctttccagctccttcagcgggtatatcccctcttctgcttttttcagggcttccccggaaatatccgtggccgttatccggattcccggcatccttgcgcccctttccctgtaatcctggaccagcatggctacggaataaacctcttccccggtggaacaccctgcgctccatatattgcagattcccatgccgcggtcctcaaacaggtccggcaggatatcattatacagcgcggaaaaatgggccggctcccgcatgaaatatgtataattagtggtgatgcggttaatcatctcacccgccatctcacctgacctgtcattcctcatctgttccatatactgggtaaaagaggtgagccctcttttctccatctccctggccatcctgcattcaatcagcacctgtttcttttccaggttgattccgtaatttgaccgtatatatgatacaatctcttcaaactccctgttgttcagtcttatcactacacttctcccatattcccggcatcacatgaaccagtccttctgaatggatggattcctctcctgccggttctcctgcaattccccagcgggattcctgctgtccattcatgatgaccgcgcagacaggctccccgtcccctatgcggcggataaccaccggcatgtcttcatggaacaggatgcccaggatatcctgtggcgctcccggcaccccatatacacggggattgaggatgatttccttaatacagcccttttccacatatatctcccttaatccatcccggacaatcacaaaatccattaatcaacacctctttcatcacgcaaagcagtctggaaaccagccggttccagcacatatgccagtatcctcccgccctccgttccgtcaagaagcgccatggcgcttatgtaccggttcatctggctcttaacttccccgggcagttcccatatctgctcctttaaaacctgcacaagcccggttatcccttcagcccgaatgccagcctttcgttccccgcattccacagtcaccatatagggcctgctgtcctgtccctccggcaatccggtcaatacggcttccggcagttccgggtccgcttcatctgccgcagaaacccggcctatccattcaaggggaagaagaaaatgaaacccggacaaaaaaaagagcatgtatgactctgtcagaccattcataccattctcctttccaagctttttagttaacattccttcttaacatattgtttatattctaacatatatggaagagatttactatattgaaagtacagaaaaagaaccaggagcatgatttttcctgattctgtaacatttccagattgaattttatggcctgaaccgcacaggctccacctccggcgtcaggggttccatacggtattccgggaactggcttatcagctggtccagacagagggatgtgctgtggacgatatcatggcccagaaggaccaccttccgccttcccatcatggtctttttagcattgtcaagcagttcctcagggctggatttcctgagggcgtcatccaggctggcattccagtcaaaatagatgaatcccctggcgtccatggctgctatgatatcactgtaaacttcccggttatgcgaattaatgcttcctccggggaaacggtacagccttgccttctcccccgttacctccaaaacagccctgtaggccttgtcaaagtcctccagatagctgtccacactctcataaagggcttcataatcatgcctgtaacagtggattcctatggtatgcccctccgccactatcctttgggctgtctccggatgcttcaggacattttcccccaccacgaaaaatgttgcctttatattccggtttttcagtacgtccaggaccgcgtttgtattctcttccgacgggccgtcgtcaaaggtcagatacatgaccttctgggggaggacatcgtccgggacggatggggtgtccggggtgatggaactgtccaaggtggtggaaccatccggggtggatagggtatccggcgtgttggtattacccgaggcggataggggggccgggacggatggaacgcctgggactgcctgggttatatccggcttcagtacactgcctggatttccagcctggtatagataccctgtcactatctgcaggacatccccagccaagggaaccggatataccatgaatccgtcatttccacccttctccccggttgctccttccgacaccatgctgttcccaatgagcctgtcaattcccgggaactccggccggacggcaaggagcaccgccaggacagacagaatgcccgccgccgcggttgacgcggtaaacaggatgtccatcagacttttcctgcgccttcttttccatctccgtttaccggggtatggatatcttctgtacataatggctgcccctttcatgcaaaaactcctgtgtaagtggaaagcaggtacaggataatcccatacccatgccccacagcccatccttctgcgggacaccatccatcttacacaggagcggcatcataataccatcatttttgcatcatagttgcatcatttggatattttcaaaaagaattcattgattccttcatagaatcccacggtgacaatggtcgtctcccctgccgggccagggcatgcatatttcttaaaataaggagtggtctccatcaatgggttggcctcctcatagggctggggctgcaaaagccccatgtagctgcaccaggtttccattatcctgtccgggtccatttcctcccagcggcgcggggtcctgacgtaaaactcgtacattttcccatcatccgcatcaatgtatgcgtttatcagatggttttccttgtccgcattcttctggatgtttgacatttccatcttccataccgctacgttattgcgcggctccagcacatcaatggcagagtagaggaccgcgtcatacgtccctgcatccacatcctttaccgtatccggcagtatgccaagctctttcagcgccgccagtccctggttgcaggtgccgtatatctgggcatccgtgatttcttcaccggaaggccctctgtggtttacaacaaatgcataattcccttccagctccccatatcccgcttccgtattgcttctggtgactgcatactgttcgctttcaggcaatacctggctgctcaggctttccgacaggatatagagcttctcaccgcggcttaaggtataacggtacccctccccttcctcctgggcatccacctggtgcaccgtacccagcaccgaccggtcccggtacctggcaaacagttcaggaccagctatggacagggccatgacaaggacggtaaacaggatcaggagcaggtttgtcattatctttctcatctcatccctcctccggacgggccggaagcacaaagcccatgcaggtgcctttccccggttcactttctatctccagacggcttccatgcagaagaaggatttccgcgcacagggccagcccaagtcctgccccgttcctgcttcttgatcgggacttatccaccatgtaaaatgcctttgtgattttgtgctgttcctccttggggattcctaccccatagtcctttacttcaaaccggtacccgtccttctgaagacggccatagacttcaatgaggccgtctgcctccgatgccttgcaggcattgtcaagaaggttcatgagtacggatttaatcaggtttgcctctgcccacacaaatccttcatcgtagttgaaatatattttcgcgctcttattcagcacatacatatcgtaaagataaacaaacagggattctgcagaaaccacggtaaattccacttcgctgcgccgggtgaccatgatgtccagcagacggaaggacatggtttccagccttttaccttccgtatagatatagttggccgacatgaactgcttttcctcatccagcttgcgggagcgcagcatgtccgcatatccgataatggaggtcagcggcgttttcagttcgtgggcaaatgcagccacaaagtcctcccttgcctgtatctcgtcctccagcttcccgatgttgtcctccagcgcattggccatctggttaaagtccgatgtcagctgccccagttcatcgctgctgaccttcctggcacggtaatggtaatccccggacgccatgcgcttggtggcacgggtcaggaggcggatgggcctggtcagccaggaggatatcagatgcatgatgaaggtgccgcataccagcatggcaacggtcacctggcggtagacggaaaagcccagggcccgttcccggaacacatccgatacatcccttaaggtctccaggtagagcgcccggtccagtgcattgaccatcgtgcctgcctgtatgtagtagccgccatccagctttatgacccggtaggtcttggtgccggaggctgtctggtccaggcttttgttgtcagcgtcaaaaccgatgctggcatacaggacctgcttctgctcatcagaaaggcgcagcatccgtctggcgctgtgtccccctgtttccagattggaggcaatctcgctaatcgtgttatcctgcaggacatcatatttggccggcacattcagggccgcggtctcaaatgcaaaccgcaggatgctgttgtcatccagcgcctgtgccacttccctgtccatcgctgtctcaaacacataattcacaaaatagaatccgctgaagccaaagccaagggccattacaatcatggtgcataacagcagtttcagtgaaaatttcatcctgatacctctaagcggtatcccactttatagactgccaccaggctgttttcccagccaagcttccttctcagcctctggacatgcagatccagggtacggctgtccccggagtattctccttcccataccttttcataaagggtttccctgaaaagggcaacattcttattccgtatgaagaggaccaaaaggccaaattccttattggtcagcaccaccggccttcccgccttggtaaccatccgcgcctccacatccacggtcacatccccggcgcttaacaggtgttctgtcttattataccgcctcaagaccgcctcaaccctggccgtaagttccaccacgtcaaatggcttcaccagataatcatccgcgcccagccgcagtccctttaccctgtccttcacctcgtgctttgccgtgatgaagattacaggaatcccaaggggacgtatgtattccatgatgtcatagccatcggctcccggcagcatgatatctaaaaggatcaggtcaaatgcctcttcttcaatcatcttaagcgccgcaatcccgtcctggaccgcagcgcactggtaaccgcttgcactcaggttcatatcaatcagatcacagatcggtttctcatcatccactatcagtattcttatcattgccctgttttccacccccaatatgcgcgcgcacgctccaccaattcagacatggtgtcggtatcgctgcattttaccgtctgtttgatatccgtatcctcataaaaaccagccgtcctctggtaatagaccgaatacccgctttccaccacggactgtccgccgcttccctcatagctgtagctggccagcaccatgatatccttcagtccgtcgccgtcaatgtcctggcagctgattcccttaagcccgtaaagattctcataatcccccatgggctggaagctccatacaatatatccctgttcattgaccagataaatcatgaacacggtatattccgccatgcggtaggtgccaggcaccacaaaaaggcggcccagcttctcaaactgcctgggataatactggtccgcggcaatctcaaagccattgtccagaagttccttctgggtggctgccgtgtacaggaattccgtggaatacccatcccttataaaagatgtgatgaaccggatgctcttattcatgccaaagcggttaagctggtccgacagcctgtagtccctgtaaaatgccccgttcttctggaacagtacatcgcccactttgtaaatgccggaaccggcggacgccggcgcttccggattaacaggctggtccgcatccccatagctgcaagccgtgatgaggacaatgtcggacaggccatcgttatccatgtcctggaaggaaaccgctgccagccattcattgggctggccaagactgcccctgcgctggctgttggtctccagccggtccgtcttaaacaccagccgtccgtcctgccctgcaaagaacagggccagccggcggtactgtgtatcgtaggcagggatgaaggaaacctccccgtgcccctttaactccactgggaatatctggtcttcaattatctgaaaacccgcaggccctatgtcacccttaacgtctatggattcaaaacggcggcagtaatcctggtattcccgggaggatgggatatccgccgttctcccggccccaaacgcacggctgtccaataccgccacagacaacgaaagaatcaggagggcaggcaaaagcttattctttctgaaaatcaaacgtatccctccacttctcccttgtaaaaatcaggcttttggcaaccaaaaacaactcaggaccacacaattacccccatgctatcccgcatcctaattaatagtatcgcaaatagaatgatatttcaaccagatatggtcattgacttacgccctgcctaacaagcctccgcaaaattcccggtatacaactgataatatctccctttcctcccaatcagctcatcatgtgacccccgctcaatgatccttccctgttccatcaccatgatacagtcagaattgcggatagttgacagccggtgggcaatgacgaatgtggtccttcctttcataagggcatccatgcctgcctggaccagggattcggtcctggtgtcaatggaggaagtggcttcgtccagaatcagcacaggcgggtcagccactgctgccctggcaatggcaaggagctgtctctgcccctggcttaagctgcctccgtccccggtcagtacggtttcgtaaccatcaggcagacggcgtatgaagctgtctgcattggccagcctggccgcattcacacactcctcatccgtggcatccagcttgccatagcggatattgtccattacagttcccgtgaaaagatgggtatcctgcagcacaatccccaacgaacgtctaagggccggtttcctgatcttatttatgttaattccatcataccggatcttaccgtcctggatatcatagaaacggttgatcagattggtaatggttgtcttacctgccccggtggaacccacgaatgcaatcttctgtccgggctctgcaaacatctttatgtcgcgcagcaccatcttggaatcatcatatccaaaatccaccccgtcaaatacaacactgccttccatcttcttataggtgacagtcccctccgccctatggggatgcttccaggcccatactccggtgcgctctttggtttccttaagggttccgtcctgattttccatgacatttacaaattcaacatacccatcgtccttttcaggttcttcatccagcagttcaaatacgcgggccgcgcctgccgcggccatgaccactgagttcatctgctggctgatctgggtaatgggctgggtgaaattcttgttcagccccacaaatgcaatgatggttccaatggtaatccccccaataccattcagggccagcagggcgcctgctgccgcacacagcacatagctcaggttaccgatgttggcattgaccggcatcagaaggttcgcgtagcggttggccttgtccgcgctatcccttaactgttcattgaggctgtcaaagtcctcctttgactgttcctcatggcagaatacctttaccaccttctgcccgtccatcatttcctctatgaatccatccacggttcccaggtctttttgctgccggccaaagtgggcggccgacattcctgaaagttttctggtcacaaggagcatgacagatgccattgcaaatgtcatgaaggacagaggtatattcagtaccagcatggagatggccgtggccgccagggtaacagctgagttaaccacctggggcacgctctggctcatgagctggcgcagggtatccacatcattggtatataccgacatgatatcgccatgggcatgggtgtcaaaataccggatgggaagggattccattttcctgaacagttcttccctcagccgttccatggtgccctggcttacggtaaccatgatcctgttatatgcgtaagcggtgatgacgccaatcaggtaaagcgcggccagcccgcacagggcggtaaataaaggtgcaaagtccagttcccggagcacggttcctgctgcctgggtatttcctgccgcccttccttttactgcctgcgccagcagcggctgtatatagtcgtcaacaagggactgtatgaacatcatgccctttaaagtagctgccgccgaaacaatgatacatgccagcacagcagctgaggcccctttataattggataccatgtatccgattacgcgttttaatatcttcagggattcgtctgccctgcctgtttttttcttatccatcatgcaacttcctcctctcccggctggccggaatccgcctgggactggtcaaaatctccccctcccttgttctgggattcatatatttccttatatattccgtttgtttccagcagttcctcatgggtgccgtaaccattcatccgtccatcatccagcaccaggatgtggtctgcatgctgcacgcttgatatgcgctgggcaatgatgattttcgtggttcctggtatggcggtttcaaaggcagacctgatcctggcatccgtagccgtgtccactgcgcttgtggaatcgtccagaatcagtatttggggattcttaagcaatgccctggcaatgcacaggcgctgtttctggccgccggacacattggtcccgccgcgttccaggtacgtatcatactttttggggagccgttcaataaactcatccgcacaggccgcctcacacgcctgcctgcattcttcctccgtagcatgggcattgccccagcgcaggttatccaggatggtgcctgagaacagtacgttcttctgaaggaccaccgccactgcatccctgagcgcctccagatcatattcccgtacatcccggccgcccacacagacagagccttcacttacgtcataaagccggctcaccaggtttgccaggctggatttcccgcttcctgtgccgcctatgatgccaagggtttcaccggattttatgtggagccggatgtctgaaaggacctgcctgccgcttccctttttgtaggaaaagcttacattattaaagtcaatgctgccgtcccttacttcttctgccggattttccgggttcctgatttccggttcttccttgaacacctcctcaatcctcttaacgctggctgaactcatggttatcatgacaaatatcatggacagcatcatcagggacatcatgatggacatgatgtaactgaacagggaagtcagctcgccggtgctcatggttccggccacgatgtaatgggcgccgaaccaggatacagacaggatacagcagtaaaccgccagcatcatgacagggttattgaatgccagtattccctctgcttttacaaacagacggcaaagcttctttgcagccgcggtaaatttccggttctcatattcctccctcacataagccttgaccacacggatgccggatacattttcctgtacgccggcattcaggtcatcgtacttctggaaaacaacgtcgaatgttttcctggctgccaacatgatgcatcccaggatacatcccaggaacaggatggctgccaggaatatcatgctcagcctggcatttatcataaatgacatgcccatgctgcacaacagcatcaggggcgaacgcacggcgatacggatacacatctgatatgcgttctggatattggtcacatccgtggtcatacgggtcaccagtccggccgtactgaatttgtctatgtttgcaaaggaaaatgtctgcaccttatcatagatgcctttcctcaggttgcaggccaggcctgaggatgcgctggccgcatattttcctgccatggcgcctgcaaaaagactgataaacgccatgatgaccatgataccgccgtaagtccatacctttttcatatttcccccctgtatgccctcatcaataatcaatgccgttatgaacggcagcatgacctccatgattacctccagggccgtaaacagcggcgtcaggatggaatcctttttatattgtttcaactggctgaatattgttcccatattttctttcatctccttttcccttattggggtgtataattaattaactagctaacaattacggtacttatattttatacctcatatttccttgaatgtaaaattcaaaaatgttataatctataaaaatcttttatcgttatttatcatatttattttttattgtggatttatgcaggagaaaatcatgaatacggtgcaattagaatgttttttagcagtggcagaatacctgaacttttccaaggcagccaactccctgaagataacgcagccggctgtcagccatcagattacatccctggaggatgaactgggctccagattatttatacggaccagcaaaaatgtaagcctgaccgaagccgggcttatgttcatcgaggatgcctccagtattataaaaatcgcctccggggcaaaaaaaagactgcggtcagatgcctgcgacctgctttatctgaccattggctgtcacaaccagtccgagcttgatctgcttcctcccatcatcagccggctggtgaagcatttccccacacttcatccttccgttaagctgattccttttaaatccatggcaaacctgctggaagaggaacggatccatgtcatgttcgggttccagtatgatgaccagaaaaagcccatcggcatataccatgaactgggcgggctaaacgtatgctgtgtgtgcccggccaatcaccccttcaccggacggaccacactctgcgcggaggatctggttgggccgctggtcctctgtgaccctcagagactgccccagcccatactccagtcccagatacgcatctcatcttcctgccatccgtcagagctttattttgtggacagctatgaaagtatattagccatggtaaaggcagggcttggatgttccctgcttcctgcctatccccggtgcgcccaggacgggctggtgtatataccggtggaggatctgtccccgattcattttggtatgtattataagagtctgaagggtaatccggtgttaaaggaattcatacgcctgatggatacagaaggcggtttttaggaaccatccgcatgtatggcgcaccaatccttagtccctggtcagcttccgtatccagttcccatagttcacctctaaaaaggccggtatgcatttaaatatctggtccgcattcaggcagcacacaacgattacaggagatgccttcaccacaaaggccatgtaaaatgacagcggcagcacaatcatccagatactcaccagatccatcttcaccacaaacatggcattgccgccgccccggatgatgccgttattggtgggcatctgataggacatgcccacgcataccacgctcagtataatcaggaaggcgttggccatgtcccttgtctcatcggataagtcgtacaggccaaggacaggtatcctgataaagaacaggatgaacccggatacaattccaatcagcacgaatattttctggagccgcagggcatacgcctttgtctgggcaaggttcccccttcctatggcctgcccaatcaggacggatgccgaggaggaggcgcccacggccatggatttgaccagcaggaacagggtggaggccacgctgttggcagcgattgcattgcttgccatgtgtcccaggattacggtctgaagcgcggtgtttacgccccaaagcccctggacgaacagcatgggaagacataccctgaaataatcctttcccagcgtcacgtcctggtgcaggtaatccccgggccttaagtggatggtcctttcctttttggcaatgtaaaggacgaggatcagcacttcaatgatcctggctgtcagggtcccgaccgcagcccccgcggtccccatctccggcgccccgaaccttccgtaaatcaggacatagttgatgccgcagttaatgcagaatgtggatatggacaggtaaaatgccaccttcaccatctcaatgctgcgcagtgtggcaagaagtatctgtgtaactgcaaaaaacaggtaggtaaaacggatgataccgagataccgcatcccctcctgtatgattcccgcatctgttgtaaagatggaaaccacccggtacggatacaggcttgccgccgctgtcagtatgacggccagggccagggcggcatgcatggcggtcactgcaattttcttcattggccctgtctgccgctttccccagtactggctgcagaaaatcacaagcccgtcccccattgcggtcagcagctgctgatatacaaactgtacctggttcacagccgccgcccctgccagggcctgttcactgtacgcccccagcatgatgttgtcagccagattcacggccaggctgatgacattctgtaaaaccagtacgatatagagtgcaaaaaagcgtcttagaaatttatcctttgtcacgtggtatcctcccaggtacgcgtatccttggctgacagaaagtgattggcatacgtgtcccagctaattatattgaatccggcggcatatttcaatgtaaaaacagaaaaggattgaaaacagtgctgtcttcaatccttctgtgccatatcttagccatatcttgctgctatgacagctgatgatatatatccataccatcttgtcataccttaccgtgacgcctgccccccatgccgggccgccggattaacctgctgtctttactgtttatccgcaaagtagatatgatacctctcctcatccacatctgccaggggcatccatttcatcccgtccgccacaaattcccggaccccgtcacggaaaacttccctggccatctggtcattccacctatccacatccgggcagggcaggtattcctcactgtcattcagcgcagccaggatatatggaccatatgcaatgctggaataaccgctgccatccggcgcaggcagttttctgaaccggaatggcaggctgatttccatccggtcatccggcatccactggcggcggatccttacatatccgtcggaatccaccgtgaagccttgggaggcctctgtaaccgcatccgtttttgccagcccgtctgcctctgcgccttccggatgcacggtgtggatccggatatcccagtcctccccggcccagcagggaatcctcagggccacggtcctttccccgccgtcctttggcccattgaaggtaatcctatacccgccctgtgtccgggcgtcctcctccagtttcagtttccacccatcctccatatccagttccgaaggaatatagaggttcacgtacacttctttcttatcttcccctgccgcgtatatgttcctgatgtaacggaaccggctttccagcccagtgccgtggcagcaggtgttctcagaggtattgaattccttccgcccgcccggacgcaccggcatgaagtaggtggttcccccgtccgccttgtggctggcagaggacaggatatggttgtagaggacattttcataataatccatcttacggctgtccggcgaaagcccgaacaggccgaaggtcagacgcatcaggttatagctggcgcagctttccgcggatttatccgtcatataatgggcgatatcgcccggctcatggaacatctccgtctcgcccactccgccaatgctgtattcatgggaacggaccaccatctgccagaaattccttgcaatagcaaggtagcgtttcccgcctcctgctttgtacagctccagtgcgccgatggcctgggggatgtgctggttggcatgcatatcctttaaagtatcaacattttcctccatgggataaaacagcttctcattgcggaagaacagggccgccctgcggtaccttccatccccggtttcccggtacaggcggaccatgacggaaatcatgccgccgaattcccctgcgatgtacatggaccacatcttatccagctgtgccctggaaagcctggacagacgtccatagacccagtcccccagccctgtaagcagatggaacgcttccttgctcccggccaggcaatagcagtcatataatcctgacattatcttatccagggtatagtagggcgcccatatctccggataccttgtatatacctccagaaggtcaaactgctgctctgaataggcgcttaggaaccctttggcgcagccctttgcttccagtgccttctggcactctgccagggcatttaccatatagttgattttgtccttcagctccggctggccgtggacactgcaggccagggccagcccggataggtaatgcccggtggtatggcctttcaggttgcactccggcgcatcccagcccgtcatcggccctgcgccccgcacatccagccctgccgcgctgcggaagttgtacagcatctggtcatcgtccacggacagcagccagcggatcatccgctcctgggcgtcccagaacctggttccttctgacagccgcacggaaccggccggcacctcgcctgcagatatcctggcaggccctgaatcctcccgctgatccgtgaccaggatctgcgcatccgcagtaagcccggtttcctctgcatatccttttacatgtatggtttttccggataccggaagggtaaacggttcccacttgaccgtaagcgtggtagggattcccctgtcatccgttgcaatgaccactgggggaagttcccccggttcccctggcctcaccgtccttttaacagggcgcaggctgacaatggacgccttcctgggttcctccagcaccgttgcctcaaaagtacggtccgccaaacctccttcataggcagaagatgcagtaaggaggatcttgcggttgcccaccccgtaagtgggtctggtcacttttccgtcatggcttatgaaaagagtttcgtgtgatttccagctgaaacgcgctccgcgttttcccctggacggcagtttcaaatccgtatccactgtgttcaggttgccaatatagatatccgccaaatcctggcggaccgcctcttccggcaggattacatctgttcttccactcattgcgcggcttcctcccagtttgcattcattggtttttccttgactgccttttcctttacagcctttatcccggtttcctggattccaccaaggaccttttcttttatccagtcttttccttcaattaccctggtaatcagcatggccagggccgggtcgccagccacgttattcatggtacagaacgggtctgtcagcgttcccatgatgacaatgatcggtatgacggatgtggggaacccgaacgcggtacagatgaacatctcgccgataaacccgccgcttggaatggtccccacgatgataccgctgagaagagccacaatcactgcctttgcaatctccccaggtcccatggacatatggaaaataccgaataggaatgcaatcttgacaatctgcaccgacaccacgccatttttatgcatactggccccaagagggatcacaagactgctgatttcctcggaaatccccatcttcttagccgcaagcaggttgacagggatgcatgccgtactgctgcaggcgcctgcggccgtggtggccggaagccagatttcggtccagtaacgtttcacgccttccgctcccccgctgatgaacgggacaatgatgccaaaaccaatgaaaaacaggatacagaaaaccgcatatatcacggacatcctggcaacggatccgatgatctggcttccgaccttgccaatcagtgttgcaaaataacaggcaatgcccaccggcgcataatacatgacaatggataccatcctgcctaacgcctcactcagcgctgaaaacaggcttatgatcggttttcccttttccccgatgctggcaactgcgattccgaacaggattgcaaatacaatcagtgccatcatattgctgatggacagcaggtccacgaaatccgttaccgtgaacatatttacaaagttaagggacgtattgcccgggtcaatctccccggccagatttaccgtgacgcctttggccgggtcaaacatcttgaccgccccgacagccagcagggatgttatcagcccgcctatgacaattgcggcaaaaaacacgcccaatacctttcccagcttacccagattgcccatattggcaatggaatttgctatggaaatgaaaaccaccggtacaataagacagaataccatattcaggaaaatgtctgcaaagggctgcagtacagccgtcttctcccccaggaaaactcccagcaaagctcccgcaaccacaccggttaacaggataatggaaaacctgtaactctttaagatgtttcttaaccttgaacctgattcattcattctgaacccctcctattattttcttttttgtcaccccattgctgatatgcctattatagaaaaacatgggctggaaaaaaagaaaggaaaggaaccatttatataataaaatcaacacaatttatatgataaaattaataaatttattgtttattacctgaaaaagtgttaaaataatacaatgatttaatatgtttgaaaccccggaaacccttgtaaatacaggcactggcctgtatgaagccatcagccggccgtgtaccggacattggaggacttttatgtatataaacatcatctgcccgcccctgccccatctgattgtgggagggatatcacttttccgcaaaggggaccgccatgagcggcgggccatccacaagacctttgacttgatttatgttcagaagggaaccctgtacatggaggaaaatggaatccagtttgatgtaaaagagggagatttcctgatcctggtgccggagctgatacacgcaggataccgccactgtgcagaggacaccgtgttttcctggatgcatttttatacggagggcggatatacctgtaccaaaaatccggtcagttatatgccgtccaagatgaacaagaacaaatactaccagaaggataagtttaccatttccctgccccagtttgggtccctgccaagaaaacagggagaccggctaaaggattatatggagcagatatcccaggtaaagattgataaatacaaccagcagaaactgtttttcgactccacatcctcccagattgagtaccagatcctgttcctacggattctttcccttatctgtgaatccaatgaacatccaaaggaaaaagacctggccggggaaatctacagttatatgttgaaggtttatgcccagcccttcagcctggcagggttatcccaccatttttccttccatcccgcctacattaccaggtgcgtgaaaaagaaataccatatgacccctctgcagctcctgatccaaatccgcatggaggaagcccgcaagcttttaaaaaccacctcgctccatgtaaacaccattggccagctggtgggatatccggacgccgcgtatttctcaaaacagttcaaacaggtcatggggatgacggctgccgcgtgcaggcgggaagcgcagggggaaagggatgcagaggtggcggaagcaggaacaaaggagccagggggggactgagttgtgagggggatggagccggaagtgtaagagccggaagtgatgaagccggaagtgtaagagacaataagaatcggaggtgtttttatgtattttccaaccggataccgtatgatgtttgattacctggattccctataccagcggaccaaggccgatgaactgggtgttcttctcggcagtatgtccctgcttggggacggggaaccggcagatcctgcccatggtcctgactgggaacaggcggtccggcaggccggggacccttccagccagacattttcgccaagcggactggcatatggctccatgcttctgttcctccggaactgggctgcaatcggaagcgacggcactgtgtcagatatctgcgacagcctggagggtaaaagggaactggatctctgggatgaatgcgtacgccgtgtccttcagaatgaggataccccgtttctgaagcttacaaacggaagtccggcagatgtattgaaggattgacctgtatgttccaggttaaatgtattaatcccatgctttagcgcccggatcagacgtccattcaattaatatactgatatactgatatcctaatatactttcaatcattctgcacaattggataccattttctacctgtttatggtacaatttgaacatatacatccaatatcatctagggggagtaatactatggcaaaagaaatgattgcaatgcttcttgccggcggacaagggtcgcgtctctatgcattgacccagaaactggcaaaaccagcagttccctttggcggcaaataccgtatcatcgatttcccgctgtccaactgcgtaaactcagggattgataccgtgggaatcctgacccagtatcagccgctggtactcaatgagtatatcggcaacggccagccgtgggacctggaccgcctgcacggcggggtacatgtgcttccgccctaccagaaagcctccggctctgactggtataagggtacggccaatgcgatttaccagaacatctcattcatcgagcggtatgacccgcagtacgtcatcatcctttccggtgaccagatatgcaagcaggattacagcgacttcctccggttccacaaggaaaaaggggctgagttcagcgtggctgtcatggaagttccatgggaagaggcgccccgtttcggtctgatggtaacggatgaggatgaccgcattacggaattccaggaaaagcccaagaaccccaagtccaacctggcttccatgggaatctacatatttaactgggacatcctgaaacagtacctcattgaggatgaggaagaccctgactcggaaaatgacttcggcaacaacatcatccccaacctgctgcgtgacagccgcaggatgtacgcctatcatttcagcggttactggaaggatgtgggaaccatctcctccttatgggaagccaacatggaggtcctggacccggaacacagcggcatcaacctgtttgatgagaactggaagatttacagccgcaacagcggtatgaccggacacaaaatcagcgccggggcatcggtggagaattccatgattaccgacggctgccgcattgacggacaagtcaggcactccatcctgttcgctggcgttaaggtggagaccggagccgtggtggaggacgccgtgatcatgggaggcaccaccattaaggaaggagccgtaatccggcactgcatcgtggctgagaatgtccagattggcgaaggagccgtggtaggcgccatgccttccggtgatgagaaaggggtggctaccatcggttccggccttacaatcggagccggcgccaaaatcggtcccaatgccatggttaacaataatgtaaaaggcggtgaagaacaatggtaaattccaatgcaaatgccctgggcatccttttcccaaacagctatgattccctggtacccgacctggtaggcgagcgtctgatggcttccattccctttgcaagccgttaccgcctggtggatttcatcctttccagcatggtaaactgcgggattgacaatatttccgtgattgtccgtaagaattatcactcgctcatggaccacctgggttcgggccgcgaatgggatctgacccgcaagaacggcggattaaacctggttccgccttttgcagaaaaaacagttaagatttataacggacgtgtggaagcactggccagtatcctggatttcctgaaggaacagaaggaacaatatgttgtcatggcagacaccaacctggcggttaactttgatttcaaggcgctgattaacgcccatatggaaagcggcgccgatgtgaccattgcctatcaggaggccgaacttccgaaaagcttcatggaagcccagaacatagggaccaacttctattacacccttggcattgaagacggacgcgtggccaagatgaagatcaatgcccgagacgaaggcatacagaatttctccatgaatatttacatcatggaccgcgagcttctcattgaccagattaacaccgcctttgtccgcggatacgtttactttgaacgggatatacttgcgccccagttaagtaagctggatgtgcgcgcctaccgctatgacggttatgtagcccgcatcagcagcatgaagagttattttgatgagaacatgaaaatgctggatgatgccaacgtaagcgcgctgttctccggcggaaaccccatctacaccaaaatccgcgatgaccacccggcccgttacataaacggttccaaggccgccaatatcatggccgcagacggatgcgtcattgaaggggaggttgaaaacagcatcctgttccgcggagtcaagattggcaagggcgccaaagtcaggaactgcgtgctcatgcaggatacggtcgtggaagccggggcagagattgaatatgtcgtcacggacaaggatgtgaccattacagcgggtaaggaactgaagggagcggatacattcccggtttatgtggctaagtaccagagggtataaaagcatgaaccaagggggctgttcacaaaaacagccccctttccataaccttacttcaattctccgctctgttctttagcccaatggtctacaacaatactgggagcatagacaaacatcatgtgaagttcatcctctcctgtattgtgcagggcgtgttttaaattacttgggatgaagatacagtccccttctttcacagcctgttcctccccatctacttccatcacaccggttccttttaaaatagtgtatgattccacagtttcatgttcatgctccggaataccgccgcccttgtacaccactacaaaaccttggcagaacttgtccccactcatcgccccattctgtcccaatattaccctggtacgccttcctgctggaaattccgttccctctatatcccaaatatttactttctgcatctcattcctccgaaagcgtcatgcctccaatttttttactgactcccgctcaatcagccttcctttaaaataggtcctgcttccatgggcgcatgtctgtgtctttatctgttccattaacctttcaaatattatttccgctgtatccgccaaggaatggcgaagtgtggtcaaagggggatccagatacttaacctgcggaatgtcatcaaagcctaccacggatatattatctggtatccgcataccgcttttggcgattccgcggtataccccataagccataaaatcattaaacatgaaaatacccgttggacgttcctcactgcgcattaactcaagcgtcctgtagtatgcatcgtcttcagagcctacattcctgataatatacttttcgtaatcctttattccgtactccgaaagagcctttaatgcgccctccaaacgttccctgttatactgccggtctttatcactgatgtaaagcgcaattttcttatgtccgttctctgccaggcatttcactgcctgatacgccgcatccacattatcaatattaatacatggcgcatcaacatcaaaaattcgattgacaataaccataggaatatcacctatgtacggtctcacatgttctatgtcctccgtagatgcaatataaagtataccgtccacaaacagatattttaaagtttcaaaatattccttttctttttccacatcccccaaggcatcacataaaataagagaatagccggctttagtagcacaggtttccatgtactttaccacttctgggtaatatgggttcataatatccggtatgataaggcctataagcctgcttccgccctttttcaagcttctggccgccagattaggtttataattcaaatcgctgactgccctcattactttttcctttgtctccggctctacaaatgccacacctgacagtgccctggatactgtactgggcgatacacccgcatattttgcaacgtcacgaattcctaccataccttcactcctttaaccgcattttactttatagtaccatttctgcggtaatcttaccagatattttccgctaaaacctcccctccggttacatgtcagctatattttccacacccttaatatatgtttttattttttcggaaatcccgccatacattctcaaaaaagtcatcgatatccggtatcggatgtacttttctccaattaaaactgcatttaccccggctgtaaccaacctcctgtatttgatcagcatgtaatccatcatccaaccggtatctgaacatatcaggcagggaaggtgccggaagcactccgttggaatccgtatacatggaacttccccgtgataaacctccacgattaacatagtcttccatagcactgagatagacatactggcaaatcagtgtttcccgaaaccggaaatacaatcctagttgctgccggctgattattttcactgtgtcttgaaaagtttccagctccttttctatggcacaacgggtattatgtatatcctccacattccttatggcagctcccaccctgctcatccgcctggttatcctctgccaggattctttcagacaaccctcctgtcctcccattgcgctctgttccatacatataatctcttttatactctgtccacatgcatcaaacagcatcgtttctggctctccccgccgtctggcggaaatatactgcgccgcccggactgcaccaacctgcccggaattcaacgcactgccccctggccggtatacgccatgggtgccactgacctctcccactgcaaaaagtccctcaatatcagtctgccaccactcatctaccttcagcccaccattattgtgctgggcactgagagccacctccaacatctcagtcctcaaatcaattcccttatcaagataaaaattgaaagcaggagtattcatatgctgcaagcggtcaacaggttttccaaaacaggctcctgcttttcttaaataatcatatgcctcccttgataaacaatcatagtccagctctgcatcacctgggtttttccgaaaatccaggaaaacacgcctgcccttaatacaactttcctggtataccagtaaatcgataatagaacttcccgacatgactttccgtacgtcaaagggccattgatatcctttaaggaaaatttttgataacatttctcctttatcatgaaaataatccaggaggaactcctttggatttctgccctctgtatccgtggaaataaaacggggcaaaacctgcatataagtaccgctcacattccagcgtggctttaacgatgccagtccaaactgccattctgtcagattcttccccattgctccagcctcaaaagcaatacccgtggcgccataatggcctgccggatacgcactgtctgcaaacatccccgccggcccgccggtagcgaaaataatatttttacaattaattacttcgtaagtcagcttatccttatttaaacagacaagccctctggccaaccttccctctgtcagtatacgcaatacctgcagatgattgtaaatcctgatatttttgtcctcaactgatttctgcaggcactctgtcattatctttgaagtatagggtcctgcgctggtggcccgtctgctgggatcgtgatcggtcttgtatcccacaaattccccataacggttgtgcgggaagggaactcccaattccacaagatgcagaaaacactgagctgacagagcagcttcgcacagagcatgttcaccatccacacactgtccgtcaaagaatacctgagccatatcttttacactgtcacattcgctgccagacagagacaatttataatatgtctgtttatccgaacctgtattacgtgatgttcctgccagaatgttctctgtcagcattgcgatatcggtctgtccatattgataaagccgttctgccgcactatatccggctgccccggttcctacaataaccgtattaaatgaatggactgtcatatccatgccacaaaagcgaaattgttgtaccctcatttttaacctcaaatacatctgcacaagttgttagttatgattaggagtgtccacactgtcagcattattacgattcaaaagccatcttcggtaaccatagtatcctatcatcacaatagtgatacatataaggctgataattaaaaaccgggccagattctgctgatgcatccgcatttttccaagtacaacaaccggaatgatcagagctgcaagaaacacccattcaaactgttctgctctctttatatccatgcatgtcctcctacattactttatttattccaaacgggcgcccttgttcgccggacctccgtattttttaaacagattaaggacacctttatatgtatttttatctttcggattctcagccggctccctttcctcaaatattgccggattctccacatcaatagaacgctgggatacattaattattacgatatccccattcctcagatatgccaaagggcctgacttggctgcttccggtgtaatctgacacacaccaaaacctcttgcaaaacccgagaatctggcatctgtaatgactgccacatctttatccagccccataccacagactgttgcctgtacggcgtaaatatccggcatgcccgggcctccacaaggtccttcaaaacggacaaccatcacatccccacgttctatctggttattatgcagcgcttccagtgcctcctcctggctatcaaacaccttagccgggcctttgtggtacaggttttcacgataccgggcagactgtcttaaaatagcgcctccagttgccaggttgccatataagactgcgatgcccccatcctgggatatcggggaatcaaagctatagagtacccttctgtcgggttcatacttgaggggactctccatgttttcagccattgttttacaggtaacagtcatgacatccgtattcaggcagctgcggacctcacgcatagctgcaggcatcccgccggatttttcaaaatcagtgagatggtacggcccattcggcttgacattcacaagacatggcgtccttttactgatttgtgcaattttatccaggttcactgcatcaccaaaaccaagttcctctgacagggacagtatatgcactactgagtttgtggaacctccaagtaccatcatcatggtaaccatattctccaacgccggtaatgtcatgatatcattggcccgtatattcttttcaatcaatttaacaatctgattaccacttaatttagcagaacgaagaagctccgatgatgtggaaatcattgtggccgctcctggtaatgtcaatcccagcgcctctgccagacactgcattgtattggcagttcccattaacggacaggctccccatgttggacaggccctgtcttccatggcggtgatgacttccgcggatacgcggccggtccgatatccgcccattatcttttcgtccagatcagacagtgaaaaggcctctccatttaattgtcctgcctccattgtacctgcgcatacaaaaatagacggcaggtttaatctggcagcggcaatcagcatacccggaaccaccttgtcacaggcagtcataaatacaatcccgtcaaacatctgggagtgtacaatggtctcaatatcaaaggataccatctcccttgtggccaaatcatagcggattccatccagccccagcgtcaaggtcccgcattgggatatggtgcagaattcaaccggagtggctcctgactgccatattccctcctttactttttgggtcagcatgttaagaccaaaatgccctggacacacctctccccaactattgaccaccgccaccaatggtctggataaatcagcatctgtaaaacccattgccttatacacggcccggcgatgtgccccctctggcccagtcatgtattgttttgtaaaatattccatggttacgctcctttcttttgtctgatcatagtcacaatctgcagcacagcgatacatgcaaaaatcacataggcaataaagttagaagccgcaaatggagctactaccaatatacttaccgcgaatgccagaaaacgttcaatattcctgagccggcgtgaaaagtatccggcaacacaaacagataaacatacaacagctattaccccatcaatgatggctatgacaatctcgccagcacttcctatggcaagggttgcgggatgatacacaaataagaaaggaatgatgtaggccgctatgccaatagtaaatgctttaaatccggttttcataggtgatgcctctgcaattgcagctccggcaaaggctgcaacacagacaggcggggttatattagacacgaccgcaaaataaaatgcaaagaaatgtgctgaaatagggcttacccccatctgggtcagcgccgggatgatagtcgtcacaaggattaaataaacccccaccgaaggcatgccgcatcccaggaccaaagaaaataaggccgtatagattaatgtaatcaacaggcttccatccgctgctttaataataatggatgataggctgacactcaggcctgaggaatacatgcatccgatgatgattcctgctgccgcacaggcaatgcctacggaaatggatgtctgtgccgtcttttcaaatgattttattatctgtgacggtttcagccttgtatttttacgcacaaaggtaagaaagaataaagtaacaactccccagaaagcccccatactggttgtatatccatagattaaaaagataaccaggcataccagcgccagaatcagatgtcctccttctataatactttttttgaaggacggcagcccattcttgtccattggatgtatgttcttctttaatccatcgaaatgtatataggatagaagggcgatgtaataaagcatggccggtatgattgcataccgcactatttgtatgtatgggaccttcagatactgtgccattacaaacgccaccgcccccatgattggcggcatataattgccgccagtagatgcaacagcctccgttgctcctgcctcctcagatgaatagccggtagacttcatcaagggaatcgtgaaacacccggtagatacaacattggatacggaacttcctgatatactgccgaacaacgcgctggagattgctgcagtcttagccggaccagctgtaaagcgtcctcctatggcataggcaatatcaataaaatacctgccagccccgctttcctccaaaatcgccccaaacagtaaaaacagtatgatgtaagaagccatagactgcacgggttcggaaaatatgccctgatcacttaccaatatatcaacaaggcgcacccatgaggtcggcgctgttttcagaaaacccggaaaatagttggcaaaactggtgtgaagcccaaaaaagaggaccacacaaaacattgtcattcccaccatacgccgggttatatccattaccaggaaaatgaatactgtcccaaaaaccgtatccagcctgcttgggcgaaacatacgaagctgccagttgtccaaatcactgatataatacacaacgcagacaactgctaaaaccacacatacaatatcgtacacagaccatatattaagcggttcataccagttcttacgctttgtcggatgaaggaaaaaggcaagcagcataataaataggacaaaaagcagacgatgggcaatagcaactggcgtaccacagtaagcagtcaccagaaaataaaccaccataaatactgaaataatactcaataacattgccagaaacgaacggggtgtcaatttcttctgatgtacagcatactcgaacagacctgttttttgttgaaaactgctcatgtcactacctcattttctagacagatttttgtcacttaatgataccgatttcacgatagaaccgctcagcgcctggatggacaggcatcttttcatcaatacctgacaaagggttattcagaatcacactgttctcctcgccaaaatactgatacagggaggatgcattttcatagatagcctttgttattttgtatacggtttcttcatccagatcatcacggcaatatagcgaggttattgccgccacagtcacaatctcttcctcctgattctcatcaaacgaatgaggtgcaatcgttatcttctccagtccgggaacattagcctggatttcgttaattacattttcatccatgctgatcagcttaataccgggtgtcatgctcatgctctgtagtgtggaattatccagaggaagcaggccggtaattgcatccagctggcggtccctgagcatatccatgcgttccgaatctcctaaaaagctgttcattccggtaaaggattccccttccagatcaataccatgggcttttaacacggcctgggctatggtatagccggtctgccctgccttacctaatgaaagatttttatctgagagatcatatacgctattcacagactcatcaccgcttaatgctacaatcagaaatggcatggaatacattgatatgaccgcattcaaattactatgaggttctgtataatccccctcacccaggtaagcctgataacctacaccactgtacacaagaccgaaatatccctcgccattctgcaatgtatcaggattagctgatccgccgcctgcagccaccttggatgtgatgccggttgcttcctgtgcaagcgccgccagctgggatcccacctgataccaacttccgccttgggaaccgctgaaaaattccagataatccggcactataccctctgtctgcccatccgatgcagcagcttcctcctgcgcggcacttgtctcatccttgctctccgtttttacttcctgagctgccttagtctcctgccctgcctttgtttcttccttcttaccagttccgcatgctgtcagtgaaccggtcaatgtgattgctaaaagaaccgcaagaatccttttcatatgtttcctccttttgattatgggcagtttcacattctcctgatatgaaatccgccatctacgtctatgtagttaccagtggtatatacaaatttctcactgcacatcaggcttacaacattaccgatatcctcggggtatccccatctcttaattggaaactggccctcctctatcatcctgctatatttatcgtgtaccactttcgtcatatctgtatctatgacacccgggcggacttcatgaaccaggattccttcccccgcaaggcggtcagcatacacggtcgtcagcatggatagtccggcctttgacatacagtattctgcacggttgggcgatgatacagtgctggacgctgaaccaacattaatgattgtgccccgtttttctccttcccatggctgactcagcatctgatttgccgctaactgtgtcataaacatagttccccgaagattcgtcccaaccacataatcaaaactctcctctgtcatctcgagaatatccgtgcggacctttggcgccacacccgcattgttgaccaaaacatcaatccggccaaagcgtttcaccaccaatgccacaaaatcctccctgaccttccggtccgttatatcgccctgatagtatatacagtccggattcaatgctttaagtccatcaaaattctcctgatacgcagcgagcgcatttatatccagtatggctgccgtataaccgtcttccaccagtttacgggcaattccatatccaatccctctgctgccgcccgttataattgcaattttattcaaaatatcacctcttctttacggttttagtattatcttaagtggttcttcaccagggctttttttgatatccatggccttttgtacttcatccaaagggaaatgatgggtaatgagtgactttaaatcaatccggccagatgataccaaatcgattccccgttgaaaatcccaacagtaactggaggttcctaccacctcaatttcttttaccattgcatctacaagggattttgtgctgaattcatcttcgaatataccaaaaataacagcccttccaccttttctcgttacagccatggcctgattaaaagtaacaggaatcccaaccgcttcaaatgtaacatccacgccgcgtccctctgttctcctaagcacctcctgtaccgcatcatgcccactctgaagtggtatgcagcccagccgttctgcaagttccaggtttcttttcataattcccagtacatatacatgggttgccccggcggcaagagacaattgtgcaagtaacagtgctatagggccgtctcccatgacgcagacagaatcacacaactgaatcctggctttcattgcggcgtgaaccgtacaggccagaggttccattaatgcgccctcgtcaaaggaaatttcatctggcaaaagatggatccaccgctccttggcatagtagtagtccgcatacccactgctgccgctgcggtactttaacctgaggttttcacagtaatcatatcgccctctctgacaatagtaacactggccacaggtaataagcggttcaacacataccctgtctcctactttgaacctggtcacatccgcgccaacctcttctatcactcctgccaactcatggccaaccgtagttggcagttttgcatatggatgttttcctgaatacagatgcatatcgcttccacaaatagcggacgacaccacctttatcataacctctccactaccaggcgtctttttttcagcttcatgtaatacaatttttccaggttcagttataagagcctcacgaaacgtatccattcttacctcctctatatcataccggacagttcatatgcgccatgaaatgcctttaaggcattgccgattgtcccgcagtccccaatctgataaaagacacccccaaagttctctgcctgcttcttaatataactgctgctctccataccagtgctcatcacaatgttgtctgcacataccttgaattccattccctccttttcacatacaagtccatcctgtagtattttctttacttttaatcctgtagaaacagttatattcttctggaaatagcgtttcagcatattgccgcggtttgtaaatcccataccaggaacaaattcatcccttcctgtaatgatacagaccttctttccctgatccgccagttcttctgctacatctgctgctgcatgtcccgctgaacaggcatggctttcactggttttcatccccacaatatcatccgggatatcctctgatatcttacggcaggtccatgtacaattatagctgcaggcaaccacaactacatattcccctaattccttggaaccatccaaagcctctgttggagtcatgacactgggaagattgataccctctatatccggcattttaaactctgctccggtagcatcaatcaatatatccggctttaattcatccagcatctctctcgcaaatgcttttcttaaccgcacatctacacccgctttttctaaagcataagcaaaatagcgaaaaacatcctcaacttccttcttagcctttgtacgtgtacagtaccaatattttcctcccagcacagcttccttctcgaccattgtgaccttatgtcccagcctggccaattccagcgaagcttcgcaccctgccggaccacctccgacaaccagtattgttttactccctttcttcttcccccgttcagccaggtatgtcatcttttttcccacacttggattgaccatacacgtaataggtttcttcatccacagttcatcgtagcatccctggcagcacgatgtacatgggatgatatcctccagatgcccattaagaaccttcgacccaaaatcaggatcacagataaactgctttccaaatgcaataaaatcagcctgccctctttccaatgtaacctcagcaagttccggattaaaacgttttacaataattaccggaatccctattcccctcttgatacgttctgccagatgaatccatgcacctctgggctggcctgaagtatggtcattaaaacttaactgggagtcacgcatgcctgcggatacattaattgcatctgctccagctttctctaattcctgcgcaataagctgggcctccacaatactatttccaccctccttaatataatcatccccgttaatccggcagatcaccgggtattcatccccacaggccgccttaatcccggaaatgatatcacagcagaatttaattccccctttcaggcctccgtattcatctgttctctggtttgaaaccggggagaggaaattattggccagataaccgtgccccattataatctccactccatccaggcctgacttccttgcgattaccgcagccgcagcaaacttgtccacaatcccagtaatatcctctttctccaatacctttggcgtatccggatagagtggggaattactggcaatgggggatggggctacagggtccataccagtagtgcttctcctgctttgacgcccaacatggcttaactgaacaaatactttcgcaccatactgatggcatccatctgcgatgcgctgaaaaccagatatgtatttttcatggtcaatggctgggtttaatacagaacggctgcgtggataatccacggaagtagcctccacaataacaagacctgcccctccccttgcctttgacacataaaaatcaatggattcttctgtcatatatccgttatgtgtaaagttattgttcaatgcagggagaacaattcgattttttatacttaaactgccaatattgccttctcggcccaatgcttcaaatttcatctcattcctctttttgaatcagtattatcctaattgacggttacttttgatgaacacattattttaatgaatatttaactaacacttgatatcttccgttatatccccctcccatgaaaccgttttcttgacttgttatgtatatattatctcaagaaaccgttttcgtcaatatatttttatacatttttatcaataaattttatttctccacattactctgatacaaaaatatgaaccaccataaaaaagtatctcttgtcgaaaaatatgctttccaaaaatacggtgagacagcacaaaaataccagctggcatatatccagctggcatccaatttatattttttatctgtacacttaacaatgtcccaggaataacaagtcaggccagtatcttccccccttctcaccacaatgagatgatttcctttccaatgacaggttccgcggttcccttcttcctgtcaatcccataggaattaagacggtggaactgtcctggtttttcctcatatcccacagagaggataagctggctgccatcctcataatccaccttgaactccagttcttcctcctcatcctggtacaggcccaggtccttcagtttattatccagaagatggctggctgcctcggatgtgagacttggtctgggaatccatacgccggtctgggaatccaggtaataccagcgtccgtcaatccggttccatcccgtcaggacgaccgtttcccgggtatcctggacgccgccttcccgggccagcccgtccccagtttcctcgttttccacctcataataccagtccccgatttcatcctgtatccactgtcccgcccaggcgggaaaggaatggaaggtcagggacaggattgcagttaataaaaataccttgcatttaccggaagcttttcttaccatcctgtatcgtcctcctattggatatgtctgctggcacatgtccatcggcatatgccttttccctgtttttatattccatgataccatttcaacattaacttcatataaactcatggcgggaaaagatgcggcatacaggaccggcaggattccttatttcctaatccttattccctaatccttattccctaatccttattccttatttcctattcatttctttatatccaaaagccccagcagccctgggcggctcctgtaaggatgcgcgccacatggctccggggcctgatggtatattttatcatgttttactgtgaatcagccacactctgaacgcccttcagttcctgggccgggtcggctccggctgccacgttctgcattgcgacctggattgcagtctctatttcgctgttgaccagtttacggtttccaaccgcattgctcacataatcgtttacttcgtcaatggactgctgctgcagttcgccgtcaacggttcccgtatactggatttcgctggacaccggcgctccctggagacggttcacccaatactgctgcccctctccgttggacatgtattcaacaaacctcatggctgcttccttctccttgcagtccttgttgacagccagcacgatgtccacgccggatgtgccgcatatggttccgtcctctgtcatggatgggaatacgctcattccgattatatccttctggttggaaatctccgtcccctgaatctccggtgcggatggggaaactgggccaagatgccaggatccggtcatgaagaacacggcctttcttgcaaagaagtactggtcccgggcatccggataggtggcaacgccaagggcaccgtcctcaaatataccgtcgctaaacaggttctgccatgctttcatggtatccacaaagcactggtctgtccatgggcgttttccctgctccgcctcatagacagcgcctttctcaaattcatttgagatctgtacaaaccagtcggagttaatccagtcatccgctgccccggccgccacacacacataaccttttgcctttgctttttcagccgcgtcctttaattctgcgtaagtggtgggaaccttctctatcccgcactcgtccatcagtgtcttgttgtacagaaggtcagtcatacctgccaccagcagcggcatacctaccatgtggccgtcttcggtcacacactggttcacggctgtcccgctgatgactccgtcccagccgggcaggtactggtctgccagccctttcatatcctcggtaaacggcgcatactgtttcgccatcgggcctgtggtaagcccaaacaggtcgggacccgtgccggatgccattgcaacctgaagcttttcaaagtaatcgtcctgctctgtcctgatatactcaatcttaatatccgggttggccttctcaaaatccgcaatcattgtcccggattgttcaaccgtcggaagccaggaccagtatgtcagggtcacctgctccccgctgccctctgcactgtctgcgtttttaccctccgcgctatccttcgcgctgtctgccccgctgtcctttgcagcgctttcctggttctgtccaggggccggggttgtagttcctttatcagagcctccacatgctgtcagcgaagccgccataacggctgccagtgtcattgccattatccttctctttctcatttttaaacctcccgtttctgcttttttgtatctaaagcataccttatttttactgtctgcatgactccatttttttgcgtttcatttaaatttttgtatagctgtaccgggttattttaagtccctgtatctggattgtaaatgcgtccccgcctttctgtaaaggggaaattggttccccatccagtaagatccactcctggttcctgaacaccgcatgatacagggaaaactgcttttgtccgccgcatcccgtccggatggatctctctccaagtacagtattcccgcgcatgatctgtatggacggctgttccccgtctaccgcaaactcaaactcttccgtatggttttcatcccatggtttctctgccaacactgcctttcccgtgccaaaggacagcccgcttccactggcagttccatgtgaaaatccatagaaggccgtcattctctgaagctgtctaccctccagccgggcatgtccggtcacagccatgctgctaatcgtgacctgggtaaaatagggcacaacgccaatctttcccaccgcacattccccgtttcctgccttgtcatccactccacccattcccatacacattcccatgcaacatgtacgggcggtaatcgccggctgttcatccatccacaggtcaaagctgttaaaattcctctgcacaaggagcagatgaggcactttgtagtcaaaatccacaggcagttcccagtctgcaagttctgccaccgccccgtcaaagcattctaaaagcgtcagtttcctctgtcctgaatgcagccttgcctccacataattcctctcatcccggtaatccagatagattccgtacctggccccgctgtggcttcttcctgcttttatccagcactccatacggtaaacaaggcggctttcccctgcccagaaaatctcctttacctcctgtttccgcaccatgatatggggtgccaaggggctggatttttcccacatggatggaccgaagcacagcatatggctgccgttaaaatacagcgggtcaatgcgcatattcctctgttccgtcccaagaacaagctcatccgcagcattccttccatggtatacaatccagtcgtccaccaggttaggcgcctttgtcacggtgttgtgcccggtgccttccaccagctcattcctctttaaaagcggacaccaggtataggggtcaggatacttgtgccactccatctcatggaacactgccttctcatccgccaccgaggtccccacaaaatagtcctcatgctcataggcattggctgaatagagaagccacgtcttcccgttatgggacacggtgcaggccccttcgatggtgtaccagtcccttccatccccaaacctgttttcttcaaatatttccttgcggataccgggcgccactaccggccttggatggccggaaaactcgtatggggtgcgcatcccgtctaacaggatacaggtcccggccaccttatcctctgtcccgaaccagtcattgacagaatagaacatatacattttcccgccccacatcaccgggtgggaatcaatggagaagtggtcaaaaaatgtcttttcccacacaaaggggccaaggggatcatctgattttgccaccttaagatgctgctcatgacagtctgtttcctccatggggatattggaataatacatgtaaaatgtaccgttcagatagatgacggagggcgcccagtaatggtggtacccctgttcacggattgcatatcccctgtcctcccagtgcaccaggtcctctgaaacacttacctttgcaccgtgttcatcggacgcataacagtagtacagaccgcaccagcgcaggatgaagggatccgggtttgtatggatcttcccatctgaaaacgggaccgggttacaataggtgctgctgcctgttacaggcatgaaatcattcatatgtgacctccagattaaattaatgattgaatcagcctttgaccgaaccgctggtaattccccccaccaggaacttctggctgaatagatatacgatgatggacggcagtgtgagaagcatcatgaccgcgtaaatcctggccacgtccgccgggctttggtaggtactggatacaaagtactgggccgccagggtgaccgtatagtttttctcgcttctcatgaccagaaggggaaccagatagtcattccatgaatagatgaaggtcagcaccagcacattggctatgataggtccgcttaagggcaccatgaactccagccagatgcggaaactggatgcaccgtcaatcctggcgctctctaaaagctcatccggaatggtgtcaaagtaattcttaatcatcaaaagcatcatgggcgcgttgaacgccaccagcgggatcatgacccccagatgcttatccaaaagcccaaaattcttgatggccgcaaagagggggctggtcacggcagccaccgggaccgcaaggcatgcaaggattgcgccgtacagaagccttcctccgaaaaactgcattttcgaaaatgcaaatgcagccagggtggttatgagcgtgaccaggaccgcggtactcaccgcgatgaacatactgttgaacactaccctgaagtagctgattttgtcatagctgagtacatattgatagtttccgattccattaatctgaaaggattttacaaaggcagtgccgattggcagaagccatataagggcgcagaggacaaataccaggtacgtgggcgccgctgttttccattgattctttttcatcctcaatcctccttgccaagcttaatctgcagaaacgacatgatgaccgcgataatcaggatggcaacgccgatggaggccgccccacctgcgttaaagtccttaaaggccttttcataaaggtaggtgttcagcacggtgctggaccttcccggaccgcctcctgtcagcagctttacaatgtcaaatgtctttaaggaccccacaatcccaagtatgataaggacattggtggttccctttaccatggggaatgtgacggataaggtggtcctccagaacccggccccgtcaatcctggcagcctcatacacgtcatccggaaggctcatcagcccggcataatagatgatcatggaaaagcccatccactggaaaatgttgacgatgatgacagataacagcgcatatctggggtcccccagccagctgactgcaaatacatcaagccccaccgccctgaggaatgtattgagggcgccgttggtcggatccatcaggatacggaaaatagccgtgatgatggacgttgccatggcaatgggcataaagtatatggccttgaaaagattgctgcccggcagccggttcttaagcagcactgccagcaaaaatcccagcccggcctggatgaatactgtcccaaaaaagaaaatcacattgttgaccaccgctgtccagaaggtcttgtcatgaagcattttcgtgtaattcttaaagccgacaaagttcatttccttggacatcccgttccagtccgtgaagctggttcccaccgtacagatgatacagtagtaaatcagcgcaaaagacaggaccatcagcggcaggatataaagatacgcggaccagttgttttttttccctaatttattcattatggccacctcctgatacatattataaaaggaggcggccataaaatggatactaatattttgggatttactctaattttttgccatgaactcgctgggcgtcagcccctcagattccttgaatatcttgaagaaatacgtgtagctgcgaaaccccgactgttcaatgatttccttcatggtcatatcatggcgtatcagcaggctctttgccttgttcaccctctgctggttcagatactccacaaaccgctgtccagtctcctgcttgaactgcctgctgagataggtgtaactgctgccggtgacctcggcgcatttttccagggaaatgtcactggcaaagttcttctggacatagttaaggacctgctgtatgacaggtgaatatgcctgcttatccggctgcggaccggcttcccggctgcgcgcatataactccaggatatcctcccggaactgctccaggatttcatactcccggatgcgttccagaaccgcatccctgtccttttcatccacttcccggccctgcgcaatcaggcccgccagacgctggctgatatccctgacccgctccaggggcgcccttatctcttccatccagccaaagaatccgttcagcgtttccgcagtgcctcccgtaccgctttccagttcaaataccagctgcttccagtagctgggaggcacatcttccgtgccgtaatgaagccgtctggccatggcagccgcagtgacacggttcccgcctatgtataatttgtcctccagcagcccatccatctgacaggcgtccttcaccgctgcctgaaggtccgtctggggattgccgcatatgatggtaaccgtaaggtccagcatgcggatgatctggcgctgaagccttcctgccaggtttttaatcacattcagcatgtaaagggtgctggtgacaccgttaaatgaaaccagcaggatcaggtgctcctgcctggtctgccagatcaggtacccatattccttgcccaggatctgccccaggatatcaatcaccgccttgcagatatcgtgcttataatcagccggttttacccccggcggaaagctgtaatccgggctgattgcaatggcagccatattggagcagcaaaaatccagcacgccgctgtccgccatgttcctgatattgtccgccgtgaattccttcctgtcataaaagcaatacccgacacggtgccggatggtccgttcctccggcacgatcttatatttatcccttgcctggtccagggctgatatgagatgtttcctggtcaattcatgtttcagcaggtaattggctgcgccgtttacaaggctcccccttacatagtcaaaattgtcaaaggcgctgattgctatgaccggaaggaactcattgattacatggatcatacggattaactccacgccgttcatccccggcatctgcatgtcgcagagaaggatgtcgatatcatttccccgcagccagtccagggccgcctttccatcggagaaatcagccaccacttcgtaggattcgtttttctccagcagttttttaatggtattcctgcttatcagctcatcatccacaatcatcagctttatttttgccatttatcccctcatacctccttattcctcccccgcgctgtccactgcgggcaggactaatacagcctttgtatattcccccgggctgctttcataacggattccgtagtcctccccaaagaacagacggatcctggcatttacattggaaatgccgatcccgttaaaacgtttcctgtctcctgccggggtgccaaggactgcctctatctgctcctccgtcatcccttccccattgtcctctatgacgatgttcagcctgtcctcctccctccatgcctcaatctggatggtcccctgcctggacaggtccgcgggcaggccgtggtagattgcattttccatgatgggctgcaggataaagcggggcacgtacagttcctttgtatcctcactgattttcttttccacgacaaagtcatagcttccgctgtattcaacaatggtcaggtaattatccacgtattccagctcatcctccaaggttatcatgtcgttcctgcggtgcattacattctgaagcatggcattcagggaatggatcagggggacgatgttgtccgcgtgctgcagctttgccatccagaccacattgttaagcacattggagatgaaatggggattgatctgggcctggaggaaatccatctcaatcagccgtttctgcttttcctcctcagtaatccggtgcatcagttcccggatacgcactaccatgtggttaaaggtatgccccatctgccctatctcgtcctcggccctgacggcatagctcacggacaggttgcctgcggaaaccttctgcatgctgtcctttaacaccgtgatttccctggtggacctggacaccaccaggccggaaagcaggcctgccagcaggaggatcacaaccatgatggccccggtaaacagcgcggtccggtatatatccgccgtataataatccgatggcagggccatggtaaaggtccagtccacatcatcggcttcaaatgtattatacacatacccctgtatgggatgggagatatccagcagctcatcgccgcagttggagaaaataagggaccggcttccgtttgcaacctggaaccggcttccctccggaaggttggaggaaaacatgtcctctatgacgccgtaatcaaaatacatcacggtgtagccgattatcctctggttccagtccgtaatccccctgacagccggaaccacgtagtcgctgttataggtggacttaccgccctccacgtggatgggctccagcatgacgatattcttcttaagcctgtcctggtccagctgcatgatccgttcatagacatccccctgcccctccaccagatgggaggtggaaaaggtacatgtttcatttacgatcacgccaattcccacgatatagtacttatagccgttcaggtcattgatgaattcctttatgatcctcctgtttttcagatattccatgttccactggccgttctccatgatggtccgttcattcaaggcttccacgggccgtatgatgttcctgtcattgagtgaaaccatggccgccatataggaggtatctgtcagcagatactcaaaggcctggcacgcatccctcatggtgctctctgaaatgtccttcaggtacgtacctgccatcttactgctggcagtataccagaccgaggttatcaggatgctgcaaagcatcaggacagccgtgatgaccagcagtatcttgttcctgattgtcatgtgttttatcattgccatatgttttatcattgccatgtgttttggcatccccatacctttcatatcaccctcccacaacagacccttccttttaccattgtaacattgcattggcaaatatgttatatgagtttttgatgtttgttatgtttttttgcgttcccatcccctgctaataccgcagtgccattcctggctttcattcattgccatacatttttcttccggacatcggaaaaacccctttcatcagactattttgtctgacaaaaggggtccgcttcataacggttggattccacggtcctatctaatatgcgcgcttaatgatttcctccatatgtacctgcgcttccctgcgtatcttctcctcgtccagggtcagtacttcccggttcttcatgactatcctgccgttgatgatggaatccgtcacgtcatgcccgttggctgcctccacaaccgtgttaatcaggttctgggtgggggtcagatggggctggtctatgttcagaaggatcacatccgctttcttcccttcctccaccgtgcccaggatgccgcccttgccaatggcgttggcgccgccccaggatgccatcttaagaagggtggggcaggtcatgaccaccgggttaaaggacgggagtccccagtatgccatcatgccgtagcgcagcaccttcatctcatcaaacagatccaggttggatggggccgcgccgtcgcagccaaggcccacgctaagtcctgcctgaaggatctggggcgtctttgggaatccatggttggagaggttggcccttgggcagtggattacctttacatcccggctggccatgatggctatgtcctcgtcggaaagcatgacgttgtgggcagtcaggaggttggggccgaggacgcccatggactccaggaactgggccgggcgcagctggtaattctgcaggcagaagctgacctcgtccttgtgctcacacagatgggcatggatccccgtgttcagttcagcagcggcatcccttaccatggcaatcaaatcccttgaacaggtcatgacctggcggatggcaaaccagatggatatcctcccgtcccctttgccgtcatatgcctggtacagctcccgggtgtgcctgactgcttcctctgccgtctccttcattgctccggtaattgcattgcccatatccatggtggatttggcaatggccgcacgcatgcctgattccagcaccgcgtcagccacacgttccatatggacgccgccggaatccgcaaatgaagtggtcccgttcttaatcatctccagacaggccagctgtccgctgatataggagtcctccggccttaggttgctctcaaagggaaccaggaacctggtccacaccatggggtattcatccgaaacccttccacgcagaagctgctggcaggtatgggtgtgtccgtccacaagaccaggcatcaggagcttgcctgtcccgtccagggtttccgatgcctggaagttctctttcatttccccggaggggccgattttcttaatccatgaatcatggatggcaacgctccgttcttctgaaaccgtcatgtccgggttaaggacccggcatccgttgattaaaatatcacatttttccattctggatcatttcctcctcgctatcatggctttacgcctctttgtccggcggtacggcttagattgctcccgtggcccgcagcaccagatctgccacgaaggcagagaatataaaggttcctgttatcacaagcaatgtaatcacaaccatcttccatcccattttcgcaaagtttttaaggtccttgccaagggaaatccctgcaaacgcacctaatgcggtggcaggagccatgaatgccacctgggatgtgacctggatgatcacgtccttgaccggagatacggggcaggccagaagcagccctgtaagggatacatacatcatggacggaagtttgataaaacggctcatgaacctgctgactgtcaggccgaacagggcaatggcgcagagtacaaggattcctgctatggaatcagccaggggcatctgataaccaatcatattggtcagtatcatgattactgccacaaggcacagaagaccggcctgctggatacaatatttccttaccatttacgttccctcccttatttcctgtgatttgatttgcgtccgattttgggttccagccacgcgtacagtttcctggtaacaggaagtcccacaaaggttcccatgtagattccggtgattcctgtcagcatgtcgctggcgccgcccattaccatgatgtcttccgcgtatgagggatagatttcccccaatgtccctgccgccgcggtcatcatggaaccgctgcccaccccgcttgccatgcccatggccagtggatggaagatattccaggatgcgaccacgcctgccagcaggctgacaaacacggttccgatgacagaaccaacaatatataccgcaaacgtcccctctgtctcctttgcatccggcccgtagatatccgtggtcaggcccaggtttgaatccctgttaatggagtagcatgcgccgatggcttcctttttcaggcccagcagcagcgcgatgggaagtgagatgaaaatggttcccagattgccgaattcctgcaggatcagggccggtcccaccgccaccagcttggccaggttggctccggcagaaacacccatcttggccatgaagggcgccagcgccaccagcaccaggcttcctcccagcttgcattccccctgattgaacatccggatcacatccggtcccaggagtccgcccagtatgactgcgaataccatgggaaacagggtcagggtgccgatcccgatgttaatcttgatggttcccactgaatcacagaccaatgccagcactactgccgctgcatagactttccagtactttcttatgacggcctttacttgttccatacgtttcatttcccctttcttctgtatgcctccggtgctaaagcgcaccgggattgacaggataccttttgttgatttcatcatatcacagggcctttcacttctgtagacagaaaaaaacgatgggaatccatcgtttttgctgatactatatgatatttccatggttccttaaccttacttcccttctatgcctccttttcccccaccagttcaatgaaacgctgggccatgtccgacagcaggtaattccccttcacaataaagccaatctccaggttcaccccatccttaatggggatggcccggatatccccataagccctgtccgccgtatggtatccgcttcccaccacgaacccctggtttgtccgcatgatggaatacgcggccgcgcggtccgtgacggaaatcaccttcttcatgcggtagtgggggatgatgacttccgtataggccggattggcatccgtactcctgtcataggtgatgaatggatactggatgatttcctcggtccgtatctggctgcatcctgccaggggatggccctcatggagatagacatgggctgtccggtaggcaatatggttgaaaatgatcccacgtcccctgagttcctgcatcatctggcctttcagctgttccgcaaaaaagatgacccccagatccgccagccccttttccacctgctcaaagaccccggatgtcttgcactccctgaatcccacgttatattcaggcacatccagggactgtatgatggacatgaaggaatccatgccgcagatatggtgctgggccgccacatagaagccgtggccgctgtcctttttgtcctcataccttaaatccagatagtacaggcggttcaagattcccttgaactcaatgaacagctccttgccgtcaccggtcagcatgacgcctttgggcgtccttaaaaatgccttaatcccataatgcccctccactgcccgcactgcctccgaaacactggactgggctgcaaacagccgcttggccgcctcactgatggagcctgaatcagctaccgctacaaaatatttcatctgctgtaatgtcatgacctggtctcattcctttctccagggcgggcgcggatccccatccatccgcccgcgttccggaacactgccctatcaatagccgtgcctctttcccttatctatgaatttaccagattccggggcggttttcaaccttctgatacatcccgtccccttcttttacatgaaatgcagtataaaagtcactggttgccgataacactgcgttcacccttatgattcccggggaatggacatcgttggtcatgacataggccaggtactcatccctgtatttaccggcccataaggctgcgtaggctttataaagctccctcaggtcgtatccctcatcttttgctatctccgtcacgcaggaaaccccgcccaggtcagctatattctcagtggcggtaaggcttccgtttatcttggttccgtttacctccatggtgtcataatagtccaccaccttggctgccagctcctcaaaccgctgtttatcctcagcagtccaccagtcgcgcaggttgcccttttcatcgtattgggagccgcttgtatcaaaagcatgggtgatttcatggccgattacagagccgatacgcccaaggttggtgaccggcacgccctcggggtcataaaaaggaggctggaggattcctgccgggaacacgatttcattgttgcccggattgtagtaggcgttaacggtctgaggcgtcatttcccattccatcctgtccacagggtcatccttggtcctgaacatataatcctggtcagccttcctgatggccaggatattatccacatagaggccgccgtcctccggcgccgtcagcttcaggctgtatcggtcctggggccattgttcaggataccccaccttcaccatgatggcggccagtttcttccgcgcctctgaccgggtggtttctgtcatccactccatgtccgccagtcttctgtcatacacgtctatgaccttgcggacaatgtccgtcacatcctgtttggcatcatcatcaaaatacttcaggcagaacagccttccgcactggaatcccagttcctgctggacagactctgatacggtcctctcaaaaggctttttttcttccgtcccgctgaccgccatctggtattcctgggccgcattcagggattccatgtctgtcatggcggaaaggtcggcatagaggcaggttttcacatactcctttaaaagaggcagattgtcctccgtgagataggtcccaagcttcctgcatacgtccggttccgccaccacggtcttctcatcctccctgatgccataaatcccgcttaacagttccatggaaagggcttccggataaatcgcggacgcatccctggccgtatatacattgttggttttttttgcatcataagtttcttctattttcagggagctggatgccaggtccttcatcatggcggtcacacgttccactgtttcccctgcttccctggtctccaggccattggattcgtggagcctggtcagatactgtttatattcctccacccgctttttgttggattcctcttcggaaaaccagacttcgcgtttcagccccgtgtccggctttaaccaatacagggacttaacggaggagtcatcgctgtcccctgtatataccagccccgccaggctatagatgccgtaatccttctggaaccggagggatgcgcttaaaagctcccctaccgtgcctgcatcctcaattttattcaggaattcccctgcccgctggccgtaaccgcccttctccctggcctcccggtccagtccggtcaggttcagggcgcggatgttctcctggtcgcggatttccccggtgtctgattgggccggggtccctccgccatcttccctgcttccggtcccgctccctgatgaaaccttctggatcatatcatttaccttattatagttctcctccctcaccttacggaaccagctcatctccggctggtcggcagggatttcccagccgcccagggtcacgtggttcacggcattgtagaaatcatccacatagtccggcgcactgccctgtccggatgcagacggctgtctggatgcggttacggcctgtccgtcaccgtccatccctgccggggattccatccccgttcccgggtcctgttccgtcctgcccgccgagcagccccataccatggctgccacagcaaccgccatggccccggcaatcatcccttttgctgccatacattttatatgtctcatcttattcttctcctttaccatgcctttaaaaccaatcctgtacacgcttcttattataacccaattctactggttatcctgcatttccatatcttaataatacatgcggtatccaatccattataccccataccgctgcagaaaaaaaggcgtgggccttcctattcttccgttgggaaatccttcgtttaataatcagataatcggtaaagactatataaaaaggcagccgggccgatagataatgaaaaaagccaccgttatatgcttggcagaaaacctggattggagcagaaaaatggaaaacaaatatactgaaaaatcaaaatcaatatggagcatgacaacccacctgccgcccaggaatcccctgcccggggacctgaccgtggaggcggccgtcattggcgcgggcatggccggaatcttaaccgcctaccttcttcagaagcagggaattgatgtaattgtgctggaggcagaccaggttgccagcgggcagacaaaaaacaccaccgcgaaaataacaagccagcacgggatcatttaccaggacctgattaaaaagctggggaaacaaaaggcaaggacgtacgcccttgccaacgaagcagctatccgggcctacggggagattgtaggggaagagaagattgaatgcggttttgaacggcttccatcctacctttacaccagggaaccgtccatggtggtgaggctggagcaggaagcccaggccgcctccgccctgggaataccggcccatttcacccagatccacggccttccctttgacaccatgggcgccgtatgctttgaagggcaggcccagttccatcccctggcgttcctgaaacatttatcccaaaaagtgactgtctatgagggcacacgtgtgctgaaggtaaaaaagcatatgatatggacggaccgtggaacggtaaatgcaaagcatgtggtttttgcttcccattaccccttcgtgaacctgccgggcatgttctttgcacgccagcaccaggacagaagctatgtgctgtgcctggaccacccggatcagcttgacggcatgttctacagcgaggacaaggacggcctttccctcagatggacccacggcgccctcctccttggcggcaattcgcaccggaccggaaaaaacaggacgggcggggaataccagcgcctgaaacaggcggcaaaacagtattacccggacagcaggatcattgccaggtggtctgcccaggactgtatgccccatgatgatatcccgttcatcggaaggtactccgtgttcaggcccttctggtatgttgcaaccgggttcaaaaaatgggggatgacctcttccatgctgtccgcaatgatcataagggaccagatctgcggacttcaaaacccatacgcaagactcttctgcccccagagattccatgtcagggcatccctcccaagccttctgaccgatatgggtgaaagtgtcatctcccttacaaagggcgctttccacctgcccctccgtgccgcggacctgaaagagggtcatggcggcatcataaggatcggattcaaacggtatgcctgctataaggacgaaaagggagtcctgcacaaaacctctgcccggtgcccccatctgggctgtgagctggagtggaacccggcggaaaagacctgggactgcccatgccacggttcccggttcgattatgacggcagactgattgacaatccggcacaaaaagggaacgctttttaaggcgttccctggcgttttctggggttccctccccatccacaaatctgccgtgttccaaaaacagacctgtccctaatccatatacgcgcccttcatggcgctgaccgcatgctgggcatacagctttaagataccctttgtatatttgctcttaaaccctttccagcccttctttctctgtgaaagaaccacatccatttcctgaggcgtcttttccactccattgacacccacgatattaagggacctcttttccagattcagttcaatcagatccccctcctcaaccaatgcaatggggcctcctgcggctgcttccggggacacatggccgatgaccgggccgcgggatgcgcctgagaaccttccgtctgttatcagagcgacactggccgccagcttcgggtcggaacagatggcctcgccggtatagaacatttccggcataccgcttcctcttgggccttcatagcggatgaacacggcgtctcccggtttcacctttccgtgaaggatggcgtcaatggcttcttcctcgctgtcaaagggacgcgccgtaaggcggctgttaaacatgccgggcgggcaggccgtatgcttgatgaccgccccttccggcgccaggttgcctttcaatatggcaatgcttccattggtgccgatggcatggtcaaagccccggatgatgtccgtcctggcaatgttcctgtggattgcctggcttttgctcttaagtatcccatcacagtgttcatagtaaccgctctttttaaggtcctccaggttttcccccagcgtctttcccgtaacggtcatcacatccaggtggagcatttccttaatctcctccatgacccggggaactcctcctgcatagtagaaatactgggccggccagtctccggccgggcgtatgttaaggaggtaatgggcgcccctgtgaagccggtcaaaggtatccgcatcaatctcaataccgaactcatgggcaatggccgggatatgcatcaccgcgttggtggagcctgagattgcggcatgtaccatgatggcattctcaaagctcttcatcgtgacaatgtccgcagccgtgatgccctgccggaccagctgaagcagctgttttcccgcgtcataagcagcctggcgcagttccggcgcagtcgcgggcatcagggcggttcccggaagcatcaggcccaatgactccgccatcacctgcatggtggatgccgtccccatgaaggagcaggcgccgcagctggggcatgcgtgctgtttataataggtcagctgctcatctggtatctcatggcgctcatactgggcgctgaacttgccgatctgctccagggtgagaagctcgttgatggcgcagcccgggtcatcctccgtatattcggggggcagtgtaaatgcctccatcacgccgcctgtcaccatgattgcgctcatttcctttaaacggccgatgctcatgagcatggctggcatggctttgtcgcagctggctataaataccccgccgtcaaaggtggttgcgttggcctgtacttcaatcaggttcacgatggcgtccctgtgggccagggaataattaatcccgtcatgcccctgtcccattccatcgcacatgtccgttgcgtaataccgcgcagccttcccgccattttcatcaacgctccgtactgcttcttccacaaactggttcaggtggctggaccccggatggctgttgccatatgtgctttcaatcattatctggggtttctcaaggtcgtccagcttccaccccatcccaaggcgcagcggatccatctccggcgccagcttgcggactttttggcttcttaacataatatcttctcctatagaatcatctttttttgtggttataaaaccaggccgcctcatgaaagaggaagcttattcacttcattgataaggctgttgaccctctgcctgttcacaagcaggaatgcctgtccatccacctttgccccataatagttctggtcatagggaatcagttccacggtcatgtccccagcggttcccggtatgcaccggtattcgatggtaaggattggagggccaatcagctgggaggccatgtccgaaacccgcttttccgccgcaaaaccatagagcgggtaataaaaggcattgaactcagcctccgtgatttcatgtccgttcagggtataggccgccttgttcccatcctctggatgggtgacggcaaactccgccttcccgttgtcccacgtcagcgtaagattggtgagcgtctccgccttaaccggagcgatgcttaaggaaaggaaatcctccgccgccagatgcatgaacggttccagcccgtccttcctgacggtatagattccctgtccgccttccggatacacgtaggtataccgtccatccccgctgtcctttccaatatggagcgcgaaatcctggaccgcacctgtttcatcctcctggcgggaaccgtcctgccgggagctgtcctgccgggcactgtcctgctgggagctatcctggcgggcactgtcctgataagcaatccgaatcagactgcccgtttccttcccgcccagtccgtattcctccatctggccttccgacgggcggtataccgccatctcctcatacctgagcttcaccagcttgcccaggcatccggataccagcccggtgtcggcgggccttaacgccccgtcatcctccgagacgctccaggagccatcccctggccccggcctttgaaaggtaaatgttcctcccttttcctcaatggttaccatggtcatgttgtccaggctgattcccggcagtgtctcacggattgccatggcgttcaggctgcttgagaacaggttggaaaatgtggaatccaccgtgtatattttctccgaaccctctaccgccatgtaacagtcccccgtggcgctgttggtactgcccagatagatggtttctgtacggccagtcccggtcacctggatcacattggagggatggtccagtccatacccgccaaaatacccgcttccctctgccacaaagcgccgggcggtaagccgcgcggtcttatccagcatggtgtccacaaagccctggttcaggggaaatgtcccatcctccgcgtatacccatccatcctcctgccttacaaggacaatcctttcgtccccgctttggaaggcaatcccggtcaccgtatccgcatccatggaatacaccaccaggctttcctcttcccctgcctttcccccggcgcctgagggcatcatgatatagatgataagaagcaggagcgcggtcaccgacgccagcagaaggtttcttttctgttcttttttcattgacgtctcttcctccttatgcacaggatgctgccgccagccatcacggcagccgggattgccagcacgaacagtacgctccagcccatggcctgggccgaggtgagccttaaggatgcggatgaggtgggcttgggacggatggtcatgctgttctcctgctctgtcatccatccgattgcatttaatacaaggttggtgttattgcccccgaccatttcatccatttcctccatcagcatactggagctggagaaccagacaatcctggtcacgcctccatcggtctgctccgaagcagtcaccccggttgcaaacggccctgccgggtccccccgcttatatccaagggaagagctgtctgtctttatataggaattgggggacgtggtaaggatcccctttacctccaccgtactgcgcacatcctccgtcttcacaataccgtgggaattaggcatcagcagaaggctgccctctgcaatgaacggctccgttatctggctgctcctgatttcaggaagcaggaagttggggtaggatgggatgctgtaattgctgtccccttccacaatcatgccctgaaccgccgatacgccgtaaccggccagcacctgatccaggttcggcatcttcgccgcggtgataccggtaatcagaagcatgcgtcctccctgttccagatacgaggtaagcacctccctctcccggtcggtaaggtcagaaaccggaacgttaaggaacaggcaacccgcatcctccggcacctgtcctgctgcagtcaggttcagcctcccggtctccacaccctccttttccattgcggcggcaaaggactccgtcaattcattttctccatgtccgttcatcagataaaccttggtcaggacatccgaagtcacatagtggatggcgctggtaatctggccttccccgtcaaaatcagtggaggtcctgcccgtatcataatcatagttgaccggatacaggtccgtattgcgcagtaccctggaacggttttcccccgccactatgatgctgttgtcactgaccttatccgatgtataatttgacacaaatgcaggcgtcaggacagggtccacatattccaccgtgatatttccgtttaaatccctgtatttctccagcagctgcgtgagcttctggtcttcttttccccttggcgcgatcagatacaggctgacaggggaggtgttggattccaccagctccctggtctggggggaaatgctgtaaagcccggaggcggacgtgtcatacctggtgtaccgtccaggcagcttatgtgaaatcatattggttaacaccacgatcacggtcataaggatgcacattgccactgcatacaggccaatcttaaaatgcctgcttttcaatgaatcccatctgcgcttttccactgactgtaccgcaaaaaacaggaacagcaccacaacccccagataatatacaagatgggtgacatcgaatatcccatccacgaaatcatagtaccgccggaacagggaaaagtaccctaaaaagcgtggaaacgccccttcaaacatggaactgtccaccaggtaacacgcccccagcgccacttcacatacgctggctgtcaggacgcccgtggacaggcttttcgtcatcaccgcaagcaggataccgccaagcacgatcacagccccgaaacctgccagtgaatggagcgcctggataccgatcaggccgctcatgccattaatcaggtagctgcagagcatgattgcaaatgtgcccacagccgctatgatctggctctcagtaatgctggaaataaatatgcctatggcaatgcaggccgcccccatgaagaagaatgccaggaaacaggaataggattctttcaggggcaccgccccatagagggacagtaccagcgggcaggccgccagtatgataagcggcgccgcaaacacggtgaggatggcaaggaacttgcccagcacgatcctccccacctttaccggggccgtgaacagaagctggtctgttttctgtctctgctcctcccccagtgcgcgcatggtaatgaccggtatcacgatcagcagcacaacggtcgtattgcccagcacatacccgaactccggcacgccgccctgaaggttgaaggcagtgaagaatacccctgcaatcagcagcaggaacgccgtatacaggtaccccatcatggagcggtagaatgaaagcacctcttttttataaatcgctatcatgatctgtccctccccgtcagttccaggaacacgtcctccaggctcatggcggcggactgaagctccattatgggacagtcggctcctgccagcagccggaacacctgtgccctggggtccgtctcctcatccgtctccaggtggacggctgcaaagcctgattcatggggcgccgtggtaatggcccgcagcccccggattcctttcagcagttcccgcagaagtcccggttcaccctggaccagcatatcatagacattggtgcgctgcatccgtcttccaaggccctccggcgtatcgctggccaccagtttcccctttgacaggatcagtatatggtcacatacggcgctgacctcagacaatatgtggctgctgaggatcacggtatgtcctttccccagtgattttatgagttcccggatgtcgatgatctgtctgggatccagccccacggtgggttcgtccaggataatgacctccgggtcccctaacagggcgcaggcaaagcccaccctctgcctgtaccctttggacaggttcttaatcaggcgcagcctcatgtgggtgatgccggtcagcgccatcacccgctccacttccccgggaagtccctttcttgggacacctttcagttcccctgcaaatttcaggtactcctggggattcatatccggatacaggggagggatctcaggcaggtacccgatatggcgtttggcctcctccggctccagaaaaatgtcatgtccgtcaataagcacggttccctcggtggcagacagatagccggtaattatattcatggttgtggatttacctgctccgttaggtcccaaaaaaccgtatatctgtcctttttccactgtgaagctcaagtggtccactgcccggaagctcccatattgttttaccaggtcctttacttctatcactggtccatttcctccctcatatctggcacttagtgcctcccggcgcgtcaacgccagtcaggccctagttcctggtcaaagcatacatggcatttccaaacagctttgcgtccaggatatattcatcaatgtcaatacactcatccggcctgtggcacagatccggggttcccgggaaaatggagccgaagggcacgatattcggcaccacctgcgcataggtcccgccctcatggctgggggtcgaatccctgcccgtcagttcctcgtaaacgccccgcagcgtccggatcatggggtggtccatggggaacctgtatgtgttatgggcatccacctcgtctatcaccattcccgccggaacaacctgggcagtaaaatccgctgtcacctggtccttgtaggtatagggatagcggatattgaccacccatttcagtccgtcctcatccacatccatcttcgaaaggctgaacgtaagcctgccgcactcatcctcgcgtttcatgccaagaaggcttccgtccgtggtcattcctatcttctcagcaaagaaccgcaggaaggtccccatggagccgtcaatgcccagcccgtctaagaacatcaggattgccacaatggcattcttaccgttaaaaggcgtacaggaatgggcgcacagtcccctggaggtaagccgtatcctggttccctcccggctggccgtcacatcccttccggtggtccggcggtactcctcaaccagtcccatcacgcgccctgcctctgtttcatccgaggcctccagctctgccgaagccctgtccggtaccatgttgaggatttcccctccatgcagtcccacgaccctgaccttggaagtggatttcccagtcaaaccataggacatgaaataatagttaatccccctttccgtaaaggacatggggaaaagtccgtccggcgtgaatccggcgtcaggcgccccgcactgggatacataatacttcatgtcatccatgcccttttcctcattggtcccgcccacgatgcggatacggtaatccccaaggggcagtccgcattccttaatggcatgaagggcataaagagaagcgatgaaggggcctttattgtccacggtgccacgtccgtaaacccggttattgtggatttcaccgccaaagggaggatacgtccatccatccccctccggcacaatatccagatgggcaaacaccccaaccaccttgcttcctgtgccgtattcaatatagcataccctgtctcccacatttacaaccgtctcaaagcccagcttcctgcccaggtccatggcaaactgcagggcctgccgggacgcctccccgtagggcgcgccttccttcggctcgccgtatttgctgggtatgcgtacaatctcagaaagcgactccaccatctgcgcgctgttcttttcaatacaactgtttaattcttccatcatcgtcctgatccatcctttctccctgtcagacaatctccagttccttgctgtaggaattaagtatctcgcacccatccccggtcaccagcaccaggtcctcaatgcgcacgcccacatttccttccagatagatgcctggttctatggagaagatattgcccggacgggctgtttcctggttcgcactggacacatccccataatcatggacctcaatcccgataaaatgccccagcctgtgggtgaacttatcgccgtaaccagcgtcctcaattaccttcctggccgccgcgtcaatatcacagaacctgacgcctggttttatgattgcctctgctgcccggttggcctgaagcaccagttcatacaccctgcggtgttcttcatcggacacttccccgcagaaaaaggttcttgtcatgtccgcgcaataactgtccttcttgcatcccacatccagaagtatgcagtcccctcttttaagggcaacgtccccgcagcggtaatggcctatggccgcattggacccaaaacacacggaaggagggaatgacaggtcatcggcccccagcctctggtatatctcttttatctggttggacacttcacgctccgtcacgccttcctttaacagcgccttaaattcagccatggccctgtcattgatggcggaaatcctgcgcatggcctccatttcctcctcatccttcacggccctggccccgtccacgcagatggatgcatccacatattccgtgccgcatcccatggacatcaggggcagaaggaaacgcgccggcatatttttatccacccccaagggtttggcatggtccgtacagtctgccagcatctgaagatacgggtccgtgtcagaaaaacgcacggtcttcacgccgggatctggcggaagggtgaacatattgttcacaaagaagcagtcatccctgtgacggcccaggtataatgccaccaggcgctcccctgcatccacccagatgcctgtcaggtaaaagatggagttggcgtcggttatgatcatctgttccagtcccatccgttccagcctgttaagtacttcatccactctcgtcttcttcatatgccctcctaaaattcaatctgcatcagcctgtacagcgcaaggatatagatcttcaatgacatcttaagccggtcaatgccgattccctcatcaaatgtatgtatcttccccacaaaatcaggaagcggctcagccgggatctcagtcccaaagctgattgcgttcttaaaatgacgggcataggtgcctccgcccatggtaaaaggcttgccgtccaccccgcggatttcattgccggcatccaggcaggctttgatttccggcttatccacaccgatatagaagggaacgctgtcctccacatccgttacctttaccccataccgggcgcccagatcggacagctttttcaccaggtcactgccagtggtattggttggatatctggaatcaaagttctgcttcagcacaccgtcctccatccttatcatcccgccgatgatgcttaacggcgggaaaatgccatcgtcacactggatacccagcccatgcccctggtagtcctcacacagcagggaaacgaccttcaggaatttttcttcctctttggtcacaaggctgttttccaggagataatccgcaatcaggccgatggcattaatggtcccctctgcatgggaggcatggcctccaataccggcagcctcaatccttacgcccccgtccacggcagtaaccataatccggtctgcctccgggcactgttccggattggcgcggataaccgcggacgcctgatcggctaccgcgttatgggccataccgccctggaaatccatgattgccccgtcttcaaaccgcccgcttgtaaaattgccgcacaggcagcctttctccccgttacacagcgggaactccgaatccggtgtaaaaaggaataccggctcctcatagtgatggatatagtattccacatcctccatgccgctttcctcatcacagcccgccatcatccgcagactgtagggaaggggggcgcccaggtccttaaaaaactttcccatataataggtgaggatcagggggcctttattatccacaacgccccgtcccatcaggtaaccgtcctttaccaccatgtcatacgggtctgtattccatccattgcccgcaggaaccacatccaggtgtgcaatggtgccgatgtacgcctctttttcgccgggaagctccgcgtagcccaggtaatcctcacagttcacggtcttaaatcccatacggcctgcaatctccaatgccttgtccagggcgcgccttatctccctgccaaagggggcgcctgtttccgcctccgacttcacacttgggatatccaccactgcctttatatcctttatgatatcctccatgtttgcctctatgaacgcatctgccttgcgcagtaattcctgttctgtcatatctctcctccttatgggcatgtaatgtgcttttcttttaacaggacccctgccgaaccgtatggtcaggcaggggtccgtatgatgatacgtatggattgggggtttacatatcctgccagtcaaaggcgaactgggtcatgactgccacaccggaccaaagggtctgttcattcaaatcgaatctggaactgtgctgcgggaaatccctttcatccccaaagtttcccccatgataataatacacgcagggaacccgttttgtaaactcactaaaatcttccccgccagggattgcgatttttacctctatcacattttcctttcccagggctttttcggcaatggggacaaaccttcgcaccatctcagggtcgttgtccgtggtgcccaggtaatggccgtatccaacttcagccgtacagcgcatggtcttggccacgccctcgaagatttccgtcagacgctggtaatagaacgcctggtcctcctcgttgttggagcggatggaaccttccaggcagcaggtatcggggatgatattattcttatcccctgcatggaacatgctcaccgcacagatggccggcttgttgggctgcttttcccggctgagcacggcctgaagctctgttaccgcgtagcaggcggccagcagcgggtccgccccaagatggggctccgcgatgtgggcgctctttccatggaatttagcccaccagccagtgatacagaaggaggaaggttccggtgtccagccaatctgggcaggccctacctcctggaaacggctggtgcctgaatgatggccgatcatggcgtccaccttcggattttccagcacaccgtcctctatcatcttaagcgccccgttatccccttcctcgcctggctgccatatcattttcacggtgccgcgaagcttatccctgttctcgaacaggatttttgcgattcccaggcccatggccgtgtgaccgtcatggccgcaggcatgcatacagccgggattcctcgaggcaaacggaagtcctgtttcttccaggatgggcagggcgtcacagtcagcccggattccaaggcatttccccggaaggctgccacggatcacggccgccacgccgtggcagtcctccccgccgattcctgaacgcacttcctctatcccgatttcctttaacaccctgaggatgattttctcggtttccacggtcttcatcccaagctccgggcactggtgaagttcccttctccagtcaatgaccagatcctccactgatttagcaagatcttttgtaatgatatctgacatatgtccctcctattttgcatccagttcagccagctgctgacggttttcttcttcaatccttctcctgtccgctgcaatcttcttccatgcatacaggatcagcgataccgcgatgatgccgtaacacaggaatacccggaaatactcgcccagctggggatcgttaaagagcaccttgccggccaggggggtgatgaagaacaggatatggaacaggatggttcctgagaacacctggcccatggttgccttgtcaatggacgcgccgcccaccagcagggctgccacggcataggtccccacctgttcgtggctgttgaaggtctgcacattaccgatgttctgaaggaaaatgatctgcccccaggacgcaatcacggttgacagcacggtcgccacgatacgcgtcttatccacattgataccggccgccgtggccacctgcatgttcatgcccacggtcctgatgtcctgtccaagctttgtctttgtgatgaacaccaccagaaggcagacaaccgcaatcacgatggctgtaagcatgggaatctgtacaatgaaaaatgccttctgcacggatttaacggtcttcatgaggatctggagcactgcaaggagaatgctggccgccagaaatcctttggtcgtaaacagggcttccctgacatctgatttctttttcactatcttataagccaggatacacacggtcaccgccgcaaaagcagccagcagccatggaagcagcttcacgaacatcaccttccatgcattgtccaccgcgtactttgtctcggcgtggaaatcaatggtgttcctcaggcccacatagatggtctcgcctgcctcgttctgggaattcagcatgatttcggggtttaccatcgggatgacgcttcctaccatgaagatgaaaatcaggtcatatacacccacggcaaagaacccaagtatcatgcccgtgatcatttcctgtccctttaccttattaaaaaggattcctgtaagggttccaaggacaatggacaggaccgttgcaatgatgccagccaggatgataccctttaagccgtcataactccagtgggtaatcaggatcagtccgatttcacctgccatggcgcccagcacgatactgaagttcagtcccatgccgcacagcaccgggaggatcagggatacaatgaggattgcgttcctgccaacacgtgatacggtctctgtgatcacatagcccgcattctgtccggatatcttaatgcttgccagacacagtacggtgaaaaggatagggaccatattgccctgaaggaagtctaacactttattacgtttcttattttccatggttattttcctccattcgctctaattttggtcaatgcgtacaggatgatgccgttctggacaatgatgcggaccacctcagagatacttcccgcattgatgaccgcattggcaaccggggttgccagggtcagaaggcactggaacaggatgacccccaggaccacattgaatacgcttgcttttttcggtgtggcgccgccaatcaggattgctgccatggctggaaacgccatcatcagcggagctgaatagaactggtaaaaaccataactctgtgaatagatgttaatgccgatggccgcaatcacggtggaggccacgatacccatggtgcggaccttgttgttattcacgcccagggtcctggaaaagcccgggttcacgccgctgcagcgcatgatgacccctgcctttgtcttcatgaacagccacatgagaaggcagcccactgcaaataccagcaaaagtccggttgacacggagaaatccttccaatacggattgttctgcaggatacccatctgcttaaaatcaatcctcaggaaattatccagcactttgtcatagttttcttccagcgtcatggtcgtacgcagtcccacgcccgtgatgggccacacaatcttgggattgttgtacggaagcaccagccaggcaatggacatcagggatacgatggagaacgccatatagtttccgaccgtcatctcagagccttttacattattaagcagcaccgcgtaaaaataccccgctatgagggcaaatggcaccgatacgatacacgcgccccagaaccccgccagaccgctccagttaaactggaccgcgatggagccgcccagaaggccgcagaggatgccgatgggaaggccgaagttcagtccggccccgcagacaatggagaccatcatggccaggaccaggaatccgttcatgccgatacgcaccaggcagtctgaatatatcatgccgggattgattcccagagggaatacggaaaccatgagcaccaaaaggaatccaattaccacaaggcgcgaaacgcccaggaagttaacagctctttttatctggttcattcttatatcgcctcctcatctgcatctaccagcttagaaccgctcatcagcagtccgaatttgtagtccttatcatcggaacggaggattccggctatctttccctccgtgacaatggcaatgcggttgcacacggaacgcagctctgccagctcactggaggtaatgatgactgtaacccctttttccttattcagcttcatcagggaatccagtatcatcttctttgcgccgatatcaatacccctggtgggctccgatacaaacaggatatccggctccagggtcagtgccctggcaatacacaccttctgctggttgcctcctgataaactctttaccggctgtgcatgtccggtacagcggatatccaggtccttaatcatcttttttgcatattcaacggcgcccttcttatcataaaaggggatgccgaactttttcacgatgaacttgtcctttgtcttaagggccgcaatggaaatgttcagctcaatggactcgtccagcatcaggcccacgccgcgcctgtcctcagacacaaatgcaatcccgtcgtccagggtgtcctttgtctttgtcacatccaggaccttgccgtgtaccttcacctcacccttggaaggataaagccccatgaccccgttggcaatgctgattttcccatgtccggccagtcctccgattccgaaaatctcgcctttctttacctggaaggacacatccctggcaacctcgccgggcatgctgaccccgaaatggttgaattccaggcagatttcctcattttccacctcatggcccatctcacggttcagtatctcaacctcgcggcctaccataagctgtgacatcttaaccgtgctcaggtcagccgtgtggtaatcccccaccatctcgccgtccctgaggacaaacacgtgatgggtattattcttcacctcatccagcttatggctgatgaaaatgaaagcaatcccgcgttcagccacggagcgcacacaggccaggaactgctctgcctctgtctcggtaagcaccgcggtgggttcgtccagcacgatcagcttggtattctttttatccagctccctggcaatttccacaaactgcttatatcccaccggaaggcttcccaccctggtcctgtcgctgagttcaattcccagggaatccagggtggccctggactccttgtgcatggacgccctgtccaccaggtccaggcgtttgccaaagaccaggctggccggtgtctttttcacattctccctgttcagcttaatgttttcagccacatcatagccgtcaatcagcatgaactcctgatgcaccatgccgattccgtatttcatggcctctatgggggatttgatatgtacttcctctccgtcaatcaggacgctgcccttaaagcctcccgtctgctggattgcgggcatgccgaagaggatattcatgatggtggattttccagcgccgttttccccaatcaatgccacaatctcacctggcttcacttttatgctcacatccttcaggactttatttccaaagaaatccttttcaatgtgattcatctctaatatgtatttactgctcaatgttcttctcctttccagtaacccgtagctatcccagggttttacttacctgtcttttataaaaggaagggatgctgcttatctgcatcccttccttttgaaagcatcagggaagtttcgttccccatataaaaattgatagagagagatttaatccttaaaatctttcgtagctacacatgatgaagaagccgttgtcatatgtggttccgccgtccgtgatgttctctacgtccacttcgccgcctgctgcttcgctcagggtctgcttaaatacttctgcatccagcttctctccgtttgtcttgccttcacagaacgcttcagcataagcatagcttcctgtcatgaacagggtcataagcggtgcggtccatgttcccatgtggcctgtcatatctgcctctgccagtttctcagaaatggcgttcatcatgtaatcggaatcatataacttgtcagccggtacctcaatgcccagggctgatgggaaaccgacgaatggggaaggatcggacggcatggtgaagtaggactttgtgttaaccacgcacttgatcatcggctcctgctggctggtattggtgccaaagaaagcggtctccgtgccatactggtcaactgcgcgcggaacatcctctaatacgaactgctgtgttccggaggtacctgcatctgacatggggtcaggtgtggtggtctctaccaaggtcaggcccagctctgcgcagcggtccttcatgttctgcagacggtcagcggttggctgccatgccagatgacgggggaaggagtagtgcacgaatgtcttagcgcccatatcgcttaactcatccaccatctggaagcccatcttcggaacgttggaatgatagaaaacgtcacagtttgaagatgttgtggcggaatcatcctggtagcctgctgcaatcagaaggatgtcaggacgtacctcacggatcttctggcatgctgccgcagtgccctgtacggcctggctgaagatgattgccttcacatccgggtcagaggcaaggctcagggctgtggaaatggttgtctcctgctcagttgcaaatttatcagggaaggttgccagcacaaccgtatccggatgctgttcctgaagcatctcagccgcacggtagctctcctcactctgtgaaactgtcgtggtcatgataccgatcttgtaatcgcctgctgcttccgcaggagcctcgctgccctcagctgccccgctgtctgccgctgcctcggctgccgttgtcccggacgctgctgctgtggtagccggtgcctgggagccgccgccacaggccacaagacctgccatcatggtgattgacagcattactgatagaattttctttctcataatcaaaatcctccttttgtatgatgcttaacgtttcattaagctggcattcgtgccattaatatgtcattacccgcctaaatcctccccttgttcttaaaaaggacttttgccaaataggtatgacgtatcgctaatttgtattatagcaacatgctaatcgaacgtcaatatttttttgttcattatcataataatgttagttttacctatatttcttcttattttttggttattttgcatgtttttttaccttttccaagcaatgggagggggctttaaaataaaaaaaagatatgatgactttctgcattttacaaaatcatcataccaccttgttattattgtttcctattatcactgtaaccagacagagtttacaggctttcacagccatcatagcggctgtgaaagcctccttttattagccatgacatgcagcatcatggactcccttgcatcccggcagtcatgccgcttaattgcctccgttatctccctgtgccccaccacggtttcctccaataaggtatagttggtaagttccgaaaaaatccgtacggaagatgcaataatcggaatgatattggctgcaatataattttggctgcacactgctatctgtgaatggaaggccacatcactttttacatgggacttcccgcttctaatacaatattccacttccaggcaccgctgttccagttccctgatatcatcttcttttgcgtactgggcagccagggcagcaatttcaggctcaatgatgatcctcatgtccaccaggtcctttacagccttctctttgttctctataaggcaaagccccagcgggtcatccgataccccgtacttttcacagacaaatgtacccgccccctgctttaccgttacaatgttcctggactccaatatcctgaccgcctccctgatagttcccctgcccacatataacatctgtgcaagtgaatgctcattgggaagcttgtcacccttttgcagcttcttctccaatatgtattcaatgaggcgctccgataccttctcaggcagcgaacgttcatcctgtttctccatggtcccctccaattccaatcactctcccggctatgccatttccatttattgcatacgcgcttctaatccatattattcggtcggccgcctgttgtcaagacagattatccgctataatatggaacagaagtgattatgacacaagaaagcagagcattcagaattgtctatttcctattggatggaggtcaatccattatatggggaaatatgttttgaaaccatggcggacagcaggtgtattgaaatccttcacatcggcgcataggatgacgaacctggttcttttgagataatggatggatatgcagaaaaatgacttgaaacgccgtaaaggctgccacaggtagattcagctgcagcaactgatgcggttgtagctttaccggttccagatgagccggtaactacaacccatgattcacataccatgatctaaatccaactcaaaaaatatctgttcctccggaatcagcccctgaagcatgacgctggcaatgcctgcataccggaatcccagctttgtgtaaagtgcagaagccggttgattgcccgcatatgtatccaggcgcattaccctgcacttcatccgccttgcctcctctatggcgtagcgcaccatctttgttccgtatccgcgtccggcgtttgagggcggtatgcacagtgtatgcagtatcaggacctcatcatccctggccggatattcccaggcaatcccgtaatattcctcggactgcacctggttcagtatcatgctggcacagattccgccatcacactccattacatagagcgtcccggccctacagctgtcctcagccacgcttctggtggggtacacgcccagcacccagttggagttgctgccgttatccttttcatgggtcaataactctgtgtagccccgctccaccgcatcaatatcatgttccgttgctttccttatcatcactcatcctccaggcaggttatatagaggaaaatgcttcctcccagcgccggacacaatggacggcgcaattaaatcccagtatacactatatggagatataagtaaaacctcattttcatacacaccttcaatcatggtccagatagaccgcaatgtctaccggtaacctccatccccgccagctaagtttacaggccttcctcctccaccgatgcaggtactattaattggcctgtatacatctggaacatgccattatataaacccgtacaaaacatgtttcaattccccggcaaattcctcatcatccaaatcccagggaaatgattggattttttcaaacacattgttccctgccgcctcaatattgtccgtccacttaataaccagaaatgtcctggatggtaattttaagacacttaagcggaaatataccccgttcagcatccagcacggaccggaacgcatcgtaatccgttctgccccaaatgactgaagtatcgtcctgacggttctcccgcggacttttgcagtggctgcgtgcttcctgggcgcatttccaacaggcttatctgacgccaaattccgctttttaaccgcttcaaactgctcggtcaatgtgccatgctcctcatcatgacgcttctttgcccggtcattcaaccgatatgccacgtaaagcatgaacaggcccaagatacccgtcatacagaacaggatgtcctcaaggttccatatgatttccaaaccgccagccgcagccaaaaggcgcattccacccataaaaacaaaaatcattcccaagttaccaatcagcgttgcggtgtcgctgtagtggtaaatgatacatccccatcttatatgactgtaccaggatattttcttctgttccatatctgctccgtatcatgatgctgcaggcctgacgggccaaggcgcctgcctgacagtaaatgtttcttataactccatcatatcacataccggcaataaaatcacttatctgtatatcctctcctgcctgcacataagtggcaatatcctatttttacatagcatattaattccaacaacagaaattcccggatttttcttaataagggacaggtgattacttataacttctttagaaatatttttgctttttctatggggcctgtttagattcctgacttatgatatggtccatcaggaggacgcataatatggatattcaggtattaacacaatatttcctgcaatatggagctgtttttatatttgtcatcattcttttggaatacatgaaccttccgggatttccggcaggaatcatcatgccgctggcgggcatatgggcagccaggggacagatcagttttttcatggtaatggccctggccctggcggccgggcttctgggaagctggattttatacggcatcggccggatgggcgggaacctgtttctggaccgctatctggaacgtttccccaaacatgaaccagtcatccggaaaaattttgacctgatcaggaccaggggcgcaacaggaatcttcatcagcaagctgattcccatgatccgtaccattatctccattcctgccggcgttatccggatgaattttgttaaatacaccataagttcagccctcggcatctttgtatggaattttttcctgattggggcagggtatatgatgggtgaccaggtgtttcatctgttatcataggaggaggtccacatgaatattgcaatgtttaccaacaattataaaccatttattggaggggtgccgatttccattgaacggctgtcggaaggcttgaggtcacttgggcataaggtgaccgtctttgccccggaaccagatggcagactgtcagggaatcctgaagaggatgtggttcgttttaaggttatttaccggaaggcggaccgggggatggccctgggaaactgttttgataagaaaattgagacatgtttcagggatggggaatttgacgtgatccatgtccaccatcctgtactggtgggacagaccgccctgtatctgggaaagaaatacaatatacctgtggcctacacctaccacacccggtatgaggaatatctccaccattttaaattatatgaggccatggcttccgaggaatatccggtaagctggattgcaaggtacggaaaggaggtcctggtgccatcccttatcaccgctttcaccaacaagtgcggcctggtatttgcccctaccaacaccataaaggagcatcttctggaacagggaaccaaaaccaggatatccgtactgcccacagggctggaccaggctgcatttgaatccgataagatacattccgccggaatcagggctttgtacagtgacggatgtccatacctgttcgccaccaccgcccgtctggagaaggaaaagaacctggagttccttctgcggggagcagcatgtctcaagggcatactgggcgagggattccgtttgatggtgattggggacggcaccgagagggcccgcctggatgaattagccggattgcttggaatcagccgccagattgtatttacagggaagattgagaatacccaggtacggcattatctgaatgcggcagatgcctttcttttcacatccaggtctgaaactcagggaatcgtgctcctggaggccatggctgcgggatgtcccgtaacagccgtacgggcaagcggtgtggtggatgtggtcaggcagggggtaaacgggtatatgaccgcagaagatccggatgcctttgccgcggctgcagcccggctggtcctggatcaggatgtatggtccaggatgtcagatgaagcccgcaggacggcccaatcatatgaatccggacggattgcagccttggcggcagaacagtacggattcatgattaggcagaagaaggatgccggttatggggaacatggaaaaagaatgtctgtaccgtctattctgcggttattcggagcggcctgaccgggcggggtggcggtttaccgatttactggtaagccatcaccacacatggtccatcctcatccttgcctccaaaaccagcagccatcggtcagaccctgccatgctgttccaggttacatctacgtattcccagccgtctcccagctttacacggttccacatatgaagtttgccgtccgtgtatcctcttacattttcgcatatgatcccagagtagctgcacagggcaagaaaagcccttgcataaccgttgcatgtagaggtgccctccatgatattggaataacagctggatttctccagggtggtatcatatacggcgtttgcggctatccagccgtttatggctatcaccttatcccgttccgccatcccgtccaatgtccggctgaaacggattaattccgattccaccgcctcctgcatcctgtatatctcaccagggttgtccagccgtacctgcaggatatactgtccctgcacattggacggtaaataggaaagcagcagcctgcccgtataatcgtagttctgatagacgtaccgggcaaatgcgttgacttcctccatatccccggaaaatcccggaaccataacaaaaaccggctcatttcccaattctggcaactgggagaagagccggtgcatgcaatattcgtattctggtatataattgctttttttctgtgtataagcagaggggtcctcaggcaattggactgtctcagcgcggaccctactcatatctgcaggtatgtatgtaagggcgattaaaagcatcagccccagaccggcccgcatgattgcgcggaaaacggcctgcccggacctcctccctttcctgccgggccttatcatacgcttcccctgcgtttcaggattacaagaattgtcttaaaaataatcttcacatccatttccaggtcccactgatctatatactgcccgtccagtttcaccacttcctcaaagtccgtaatatcgcttctcccgcttatctgccacaatccggttattcccggtttcatggccagacgctttttatgggaaaagctgtaggcttcatattcatccacggttggcggccttgtccccaccaggctcatgtcccctctgagtacattaaagaactggggaaattcatccaggctggtcctccttatgaaatggccgattcccgggatgatcctggggtcatcatccattttaaacatgtttccccggattttattacgggacatgagcatttccttttgttcatccgcgtccatgaccatggaacggaatttatatatacggaatttacgcccgttcttacctacccttatctgcgagaagaggacagggccaggggatttaaagaaaatcatgggaccaatcatgagtccaatcacaagggtcatcacacatcccactgcgccgcccaggatatccaggagccgtttgcagaacagacgccgcatgggtatctcccggttaaagcaggttatcacgttcatgttgctgacccgctccagtgttttcctggggatatcctgcaaaaactgttccatgtagatatggaccaccataccgatggacaggaactgtttcgccagctccgcctcctgcctggggtcatccggaatgcttaaaagtatctcatcaacaatatgtcctgttatgtattctgataacccgtccatggagcagctgaccgggactccctggattgtctgtcccttcatgtcgcggtccgtaattgccactccctggattttgaagatggtcaggatcctggaggacaactgcctgatcaggattcccgcctgctgttccgttgcaattaccatgatggtcctggcgtatttgatattctggaatttccggcgcagacagttcttaatcatcagccgttccgcatacatgaacaggatccccacaaaaaacgtggcaaacaggaccaggcgggaaaacagtccgacaagccggaaggagaacaggcatatgacctccgtggcaaagattatggtcatctgatggatgaccgcaatgatttccttcagatatcccctgtgcaggatattcctataaccatccgtcaggaatgcaactgataacgtgatgatgaccagaagcagacccagctggacataatacacatacagcaccggattcagtttgtcctggttcaataacaccatcaggaactgggccaggcctaaggccaccatatccccaatgataaaatccagatgtttcgtccttgcgttcttcattccgcgcctccccttatggattcacgcccgccctgccggtccctggggccggacaggctcccccaggcagtacctgtctatacgatttctatcatctgcaccatgcgcatcagttccagcgcacttctgaagttcacatccacgctgttggtcagcctgcccctgatgctgccctgcatagtggaattctgacggtattttacaattgcaatcagcacttcctttgcctttcgcgcctccgggaaaggcaccaggctgcttcgttccagcaacctgtcctttaagccctgtggatgggcagccgcggcgctttcatatctttttttcatttccttattcatgaaacgtgggtctgtcgtgcgctggggcgcacccagccagttacagatttcatccattttcagtaccatgtccccggtgccggtaaacggtaccgggtctttcagataataactgcagatatggccatggacgccatcctgggtctttccctgcatacagataagcatgatgctgaaccagcctgaggcggccatatcttcaaggtacttatcaatatcctgactgctgtcttcgttctgtttcataacgtaactccttttcttaatgtatgtatgctccatccactccggcccgcctataaactcctgcagaagaatacagtatcgtccggtatcagcgaaagtttcttaatcattttcctgtccagacagtccttcaccctatagggcgttatgctgaacccatactgttttaaatgctctgcacagtccatcccgtaaaggcggattttcttacgtatttcctctttcatggatataaactccttcgtattgctttatccgctggatcttataatctgtatatatactttttctcatattcttcctggggcatgggcctggcatagtaatacccctggacataattgcaccctattttgtaaaggaaacgcttctgttcctgggtttcaaccccttccattatgacaggcatccccaggttattggccatctggattacggattccagtatgattttccccttgccgggcgattccccgccggacaggaactgcatgtcaatcttaagcacatccacatcgatatcctttaacatgttcagggaagaatacccgctgccgaaatcgtccatcagcagtatgaagcctgcctggtgcagcttcctgactgcttcctggattaattccgggtcggacacatatgcactttccgttatctccaggttcagcaggccgatgggcacgccgtactgttcaatgaggccggacagtatgtccgccagcctggggttataaaggctgatccttgagatgttcaccgtgatgggatccagacagatcccatccccaagccatttgtgtatgagctggcatacatgctcccacacatagtaatccagcctggaaatgaagccgttcttttcaaaaataggtatgaaatgtttcgggggcatcaggcccgtgtcgggatgtttccagcgtaccagcgcttccgcccctatatccctgtcattggcaatatcaaatttaggctggaaatacaccacaaactgttcctcgtccatggcggtctgcatactgctgacaatggctgcctcctccacttcccggattccctcatccatatcatagaatccaaggtaggacgcaaacttgttcttgcatttcttgctgccgataaaagcccttatgtacatttcctccactgcaaggtcaggttcttccacgatataggcgcctactgtgggttccaggagataattcttctcaaacccggccagtccctcctttaccatctggacctgcatgtgcagcctttcacagtcataaggctcgcatatgcagaatgtgtctgcattaatccttccataggtactgaactcaaagcagccggctatgccctctatgatttccgccatcgttataaggagcttatcccccctcaattcaccgaatacggcattatacagccggaaccggtctatgtcgaaacgcaggaatacaaacagggtatccatatgccggtctatcatgcgcctggtctccgcaaacatcttctcacggttatacagccccgtaagcctgtcccgttcactcatatagagcagtccttcataagacggtatcctgcagtgccggaccgcacggtccagccggttccttagtgtcttaacccggatgggcctggtcacataatcccatgccccatggtccagggcctccagaccaggatcctcctttgcatcctccaggataacaaggaccggaatagaggcatatcctgagttatggattttatccaggaatcccacttccctgccgtcctgctgcaggtttcccagcaggatggcatccaccatacttccgcatgatatctgcagcatggcgtcccctgcgcttccggcttccaggaccttgtattcttcagaaagtatcttctttaccgcctcccgctctccgggccggctttcaaccaccattatggtttttctgtattcatccatggcttccctccttccatcatccatttacctgataaagggattttcatccagggaataccttccgccctgcaggaatttatgttttatcacccaccaggccggtatccatatataccggtgcatggcaggcgatgcgcttccaatcatccagcagttcctgtcacattcttttgtgatgcgccgcacctgcctggcctgctctgaattccacagttcctcccactcctgttccttcaggtttcccatgaccgccttgtgcagcatcccgttacacggaatcacatcgcagaacggatcgataaaaaatgcattcctggacatatcgcacggcagaagacgcttattgccatatatgtaattaatcaggccatggttgaagtaggcccggaaccattttttcggtgaattgcttttgagcagttcattaatcagcttctcaaaattttcagccacccgtttcctctccacaatccggttgtcatatttcctgaaataaaaggaattgtgaagggccgcggttgcaaactccatccccatcttatccgacagaaggtaaagcgggaccaggtcaccacagttcatgtcctggaccgtcattccgaatcccacgtccgggtgtcccatctccaccagggccgtcagcgtcccatatccccgcctgtacccatccgggatgcccctgatgctgtcattggtcttctgaagcccttcaatgctgatgcgtatgcccaccttgggaaattccctgcacaggctgatgatacggtccgtaaaatagccgttggtggaaatgacgatgcggtccgactttttatacagctcccttacgatatccggtatatccctgcggatgaagggttcccctccggttatattggtgaatgccatttccggaagtttcctgattacatccagggtaatctcctcctccggcttagtgggatgtttaaaacagtcgcacatgttacagtgtgcattgcaacggtatgtcacaatcacggttccatacaggtttcttgccatatttccttacctcactgttttgtttcatatagtttcagcagcttgtcacagtacatctccaaggtgtcataccggatgtccccgcagttttccgcccaactggcgcaaagccccggggaatcccacagatgccgtatcttctctttcagctcctccaggtttccgctggcaaacagggagccgtttacgccttcctgtatcaactccgggattcctccaatcctggcccccagcacaggtgtcttaagaagctgggattcaatgacggaaaacggacagttttcataatattccgacggataaatgctgaacctggcctcctgtatcagctgggccagtgaatcccccttaacgaatcccacgttcttaatgttaggtatcccggtcacgctgtctgccagcggtccgtcccctgcaaagacaaaggggatatccggcagttccctgcacgccttaagaagggtcccgattcccttttccctggaatatcttccaaaatacaggacatagtctttcttccgggcaggtcctgcctctatccggtcagcaaaattatgtaatgtaatggtcttattcctgaataattctacctggttcaatttatcttccaggaaatagcttggacagacaatccggtcaatgcagcggtaaaccttcagccttctgtatatggctccctcggcagcacccagtatgctctttacaagggactggtggatacagcgcttcctgatacagccaaaaaaacggccgcccacacactgctcgcagttttgtccgtccccgggggaattaagcatatggtttggacatataagctggtaatcatgggcagtgtacaggacggttgtcctttttcccgtttttttttcaaaatcccggataccatagaggatggaaggggtcagctgataattaaaattgttgatatggaccgcatccggcttgaaatcctccaggacacgcatcagctttaccctggcttccctggaatatatgattttaagtggatacagaagacgcctgtatccggttgtgtggaaatccagactggctgtatattgattgatgcggttcccaagggtgcggcctggctcatccatgccgaaatactggacctggtggcctttctgtttcagacaatcgccaatcttgatgatataggtttctgagccgccctttggctttaagaatttatttacgattaaaaccttcatcccgtcctcctgtctggggattcatccgttataatgccaataggtactgcctacgtactcagccattaccaaatcttcttctgtattgatgtccacggcttcgaatttctgcacaaagtaaatatacggcttcctgccgatacggcagcggtaccgctccagggaatccttggaaatcccgtataagccagtggtttcctcaatcaccggctgcatatcctggcttctcggcaggatacccggacggtagttcaccggctggccattgacccagtaaaagccgtgattcttcaatgcagtaaaacaggaatcatatgtctcactgtcaatcagcgtattgacacattttttaatggaatccgcctgaaggtacggcgccgtggcaaacagctggaaatagtaatcatattcaggatgaagctgatggtggtaaacaagcaggtcattcccattggccgtattatgtgtgagcgcatccaggcgttcaatcacatgaagtccatgatcaagggcatagcctgtgatttcaggactgttggtatcaatataaatgtcatcaaagcagtccgcatccatggtatgttcaataatgtactcatatagcttcttgccattcagcacccggaagtttttgcccgggacacgttctgaattggctttgataggaataaaacacgcagtcttcataagacagttcctcctttgtgtgggacattccaattaacattcatgccctgctcctgaatcccaggttccaggccagtgtctttaccctatggtataccctcatgaacagccgtggggagaggcagataagcagtatgcttatgatattcaccgtcttccttggatgctggtcctgcgcggacagatactgaactgcgtggctttttacatcagaagcaaccgcgccggccttttcatgattgtacagcttaaaatgcgccagacggttcaatatatcgatgcaggtttccacatgcttcaggtcaaatgcttccaataccgggcggctctcctgggcaatacaggaaaatacaaccttttccgcatcgtacaggaccagatactttccattgaactcatttttatggtacatctgcctgcaaagtgaatcgggattctcagcgtacatgtacaccagcctgggattcacgcagatattgctgcattgtttcagatacctggtcacgaaaatcagatcttccccgtgggtgtattccacgggaaaacggatctgcgcttcctctattatgtccctgatgaaaatcttgttccataaaacgcctcggaatgccgggttcctgaacagttggacaaaggcagactcccgctccatgacctgaagcccggcatactgcttcttataaaacgccccgtttttttcattgatatagccaaatacagccaattccacatcctgtgcggatatggtgccatacatggctttcagtgaaccgtccagcaggtaatcatccgcatccgcaaaaacaacgtacgttccctgtgcaatatccagtccggcgttcctggccgcggatacgcctttcttctcctgactgaccagacggatccgttcatcgccatagccctggattacggagctggctccgtcggttgaaccgtcatcaactacaatgatttccaatccctcaaatccctggtttaaaattgaatcaatgcatcgttttatgtagggccgggcattgtacatgggaataataactgacagccgtttcttcatatcacctgttccaatctgactcttgggaacacttccagttcccctcccctggttgcattataaatctctgtccccctctgtcctgctgcttccaatgcactcttatatgcctcttccgccatctccttatcgtagacagcaagaacgattttcttcttctgctccgcagccttatacacatccttatatcttgtgtcaaaatgcgactggaccgatgcatcatatgtgattcttcggtttttatcaatcgtatgggggaaatgatggtccattcccaggagatagatttgggaaaaccccatatacaccgccagctggatgcttgagtatgtcaccgtggaggcatcgaccactgtcttttcacagtcataagaaaacggaatcttctttttcctccgcaggattgccctgtcatccatcagatatgcattgacattggcaaggcaggttccattcctcaccatggaattataaccaatgaagcagtcacattggattttccttatgttttcctcctctgctttcagcatatccttatcctggcatagataaaatgtgggccgccatctggtcctgtcatacatcaggtggatacggtttgccgcaaaggtgtattcattcctcaacagttccagatccccaggtcttaagcttggaccgtttcctatgatgaagcaccgctgtccttcatagacgcctttatacatgttaatccttgccccataggtggtcttgccataggatttcctcatcctgtaaaatgacagcgcccctacaccggccctgaaccacctgcgcagggctgacaaaaaatccgaacggaccactatgtctttaatcagttccttcattggttcccccaccttcccatctgtcacccatcaataccagttcacgtccaccacaacaatttccggtttattattaatcctcgggaagggatggctctgcccaaggcccctgctgataatgacaaccgattcatttatctcatgctgtccttctgtaagagacgggaaaaagccctgttccgtggcatagacacctcccagataaggaatccggaccatccctccatgggcgtgtccgcagagagccaggtcaaccggcatgtcctccagttcccccatgaagtactccggatagtgcaccagcagcagcttgaactcctcactcctgacatattcatccataaaccgcttcccgccgtactccacgtaattgtaaggttcgttaatcaaaccggcaatatagatgtcattggtatttacctgaatcatttccgcatcgttaaagagcatgtgcacgcctgtttgttcaatatcatcccgtattttggtcttgcggtgcgcatagtccaccagttcgtggttgcccatcacataatatacatcggttatatccaccagctgcctgcacagatccaggaccacatgatagtcatcatcatgttccatattcatgtccccggtaatggcaatgatatccggctccagtagcttcacccttgcaacaagttcctggttattttccccaaattccttcaggtgcaggtccgacagctgtacaatacggaacccttccctgaccttccctgacttgacatggtaaaaggaaagttccagcgtatcctggtccgacattattttctgccacacagccgccagggccaataaggctacaataccgatcatgactctttttaaaatgcggcccagcttccccatacgccccttgcccagcacaaaaccaggattgataaagaacagccggactgcatacaggatgctttccgggtaccggtgcgcctgtttccacaatctccagcagatttcattcagcaggttggtgcgggctgccctgttctgtttgaaatcctttttatattttttatataccttctggtatccgcggattccccgcatcggatcagaggtaatccgctcccccttgtgcaccctcatattgaatagggggacatctatccctgctgccttataccgtttcaggatccgcagccacatctcgtagtcctgccttgccgggaagcccacatcaaacattccgcagtcatcgaatacggttctcctgacaacggcctgggaagtggttccgattgtgtcattttcaagcatcccgttaaaatcaggctcctccttaaacgttccttcctggtggtataaacgcctgttccctatatcgccgtcatcaaacacatatccctggcagaacaccagccctaccccgggattctcaaagcacgggatctgcatggcaagcttttccggttcccataaatcatcgtcgtccagaaacgcaatgaactccccatggctggccatgattcccgtattccttgctgcctgtgcaccggaattatgaggctgctttatgtatatgatttccgggtatgccttcagtccctcctcaatccggagggtatattccccgttccctccgttatcatccaccactatgatttccatagggacgtatgtctgggacagcacactgtcaagcgcttccttcagcatggtgaattcccgtttatatgtggtgattattacactgaccaaacctgcttccattgtctaacctattgttatcccttccatctcataagcttttgaaataagtttgttaatctgataaatccctgtcttctttgaatccgcaatcctggccttcatctcaatcatgacccctggattcccatcgttaaagtgtttaatggcctcgcttaacaggctcaccatgaattccgctttgccataggtacagttatcaagcaggcacaggaactggttcgccccattatagccaataaaaccatattcctttgacagcgattttaatatgtttccaatttcttccagaaccttgtcgcctgcagagtacccgatggtgcggttgacctctttcaggttttcaacggaaagcaccacacaggtaaaggttcccagcgcccctcttttcttaatcttctcaatccgttcatcgcagctgagcctgcttggaagcctggtcttcctgtccacatataaagtgtattccacaatatcaccgatacggccgatgaggattgccccgcagcatccgatgccgaagaacaggacaaacgccattgtcatataaagcttcaggttcagctgcgcatatgcatccacactgttctgcattgcaatattcttactgaccagatagctgttatattccctcccggtccgggccacaatcccataaagggaatccatcctgtccgccacaaggcggatacggccctccagcatttcattgctcaaagacaaggctgccccggtattgtcctgaaagcattggaggatatactttttttcctcaatctgctgttccaggctgaatatctctttgttataatccacataatgggatatcaatgtatcatatgtattctcactgtagaagatattcccctcctcatcccttctctcatagatatcctgaaggatgatggagttggcggtttccgcacctttcgtatccgtgctgtattcctgggcttccaggattttcggattatactgccctatggtaagaagcagctcgtccgactgtgccttcatcttttccagctggatctgaaggctctggatttcatcattggttttttcaaccaggaccgccctgtccttggtcttacgacccgaaagcacgtccacatacagccggtccaggcttacttcctccagcagctggtaggatgtaatcaaatcataaaagctgtatcctgtcctggaagaacggaagcttgcctggttgctgtttagatactccagtatctcaccgatggactgtttcatgatatcgatgctctcaatgtaatcgtaattacccttacctatattttccacattgttgggtatgactgcctttgcgacatacttttcactgtaaaaatcaaaatagctgctgaggaccgtgttcagcatgtttttggcaaaatcctcagaatagtcctttcccacggaaaaggatatgtaatagtccgtgggggactcttcatactcctccccctccttcaggatggcttccttgcgcttttgctcctcatccgaaataatgggttcaactttaatcctgctcctcacaaaatccacgctgacattgctttccaatttttcaattgcatccgccaccacattgggggagtatatttcactgacatcgatgtccgttcctgacggggtctttccgcttttagcatctgtattcgtataggaaatgattgcgtaggcagtgtatacctgctgccggctgaaataaccataaaaaataatgccgcccaggaccgtgcacaaagcaatcaggtatttccaattgcttacatatcgaacaatctggaattctttcactgcccgtcctcccttgtactgcgcttattctccctgtacattacggccgttgccgccaatgctgtaaataccgctgacagcaaaactgcctttgtgaaattcatcctggtcatgagccccaacggattatcttttaccgtcacataatccttatttttatatctggagtattccacatctatctgcatggcctggttggacacattctttaattccgcgtcaatcttccatatcatttcatcggcctttttaagatcggatgcctgattatccgatcccttaatatggtcaatgatggactgcctgttttttatatccgcccgtttcttttcagcggtttcctccgcgcccactgcattttccgccagatggtcaatccccgtctttgtcttggacatatagaaatcctgattcctgtcaaccgacgggaccagcacaaccccggtcagcttggggtcatattgctcgatgcagcgtttataaaggttatatgtctttgtattgagggaatatatgttgtcatccttataatttttataatccagcagttcaacataggactggcgctctttataaaggcctttctcggtaacaaatgaacggaaattagacaggttgatacgcagcaggttatcgaccttggccctgatatcctggaatgtgatgcccccgtccgagacaaagcttttgttctcctcaatcctgccattcacataattcttaagctgtatcagtttggtgttgtaataacgggcaatctggcgatactccaagccctccgtatccgccggtctgtactggaggattgatgtattgtccgtatagttgtcatagaaatattccagatacgcgtaggcgaccatctgaagcatggactgggcgtccacggattttagttccttattggaaatatatgtaaccttgtactgggttgcgatgtaatcccttccgcttttcaccggtacctggatggttatgttctcccccagttcttccgggcttatctccgtgaccccggcaagctcaagcgccctttcaagcactgcctctgacttgatttcatatgcattgaaacgtgaaccattgggattcagccctttggacgccctttcatagttatatgcaaaccagatggttgaggcttggaagctgcttatgtagaatctgcatcccaggcccagcgtgacaatggccatgcacagcatcagtttccatttataggtacggaatgtatttatgattaagaatacattgcctttatgactcataagctgccctcctcctgaaccagtctgtgttcatccacatatgcaataaccgtaatgtgtgccactatgttaattgaataataaaagaaggtattatccgtaaggtatgtaatgaatgtgtatatgaccgtcagaagcatgaatccggatgccctggaaccgaattttttcttcacagcggaaactttataccaggtattgctccacagccagtagatgaatccccaaaaacccaattcgatgaaatgtgtcattatatcattgtgggccatgcccgggacataggtgcccacccctgttgtcttataatcgttcctgattttaaagatataacggattccatatcccaggaatgcgggagacatctcatagtattctttaaagaagtcatataaataccccctgctcatggtgtcaatcccaaagtaatccataagcggctggtaccagccctttttaatcagatacaggtacaggtacgaaaaaataaacattcctgacacaataacggccaggaatgcggtcttcattctctcagacacagcgtcatatatgattcccaccaataacgctgccaggatagccagcacatcgattctctttaatccggtggaaaagaaaaatgccgcgcatatgaattccacaacataccactgcttattcctggcacaatacagataatacatcacaaacacacccagcccctgggtcaggtcatgcagttccatcttcctcatgattgggcctgttgtatccgcaaaggtagtaatcaacgcgatatattccgacaggaagcttccggctccatggttcctgataaggtccagcaaaatcacaaaaaccgttgcgcaggacgcgtacagcatatacgaaacagtcttcttcccaaacatataatagcccgatgccgcgcacagtatattaagaagaaggcatacaacattgatggtcccccttgtgacaaaggatgtttcctggcaccgcaccagccatatcaccatggatataagcccgatgccgattatcgggaccatcatgatcattgagacggaatataggaaccgtatcctttggaagtccgccgtaaccaggatccataagagtcccatgccaatcaccaggacgtccgccacgtaacggattcccaccggcaataccggcaggccgccgttatattcagcggtggcgtaaaatgcagcagtcataatcaggatgaatgccgctgccatactcttttttacaatttcactgttttttatatccaaagactcacctgaccagattatatgctttccaaaaacattccaacaggaaaaaggactgtatgttataggtcaggaatagtatgactgcgtatctcctgctctttttaagaatacgtttatagctgtcctttcccagataccaagcataggcagtgcgtcttattaactgttcccactgcgctttcctgtgtttcctgtccgcgttccaaccggggttaaggtaatacaggcggaggatttcacagtaattccttgtggctttatattcaaacgcccggttccagtcctctggttttccctggatgtactcatgtaacactttgttaaactccaatatatactcctggatggcagggttgaaccggttgcagatggactgtgggttcttcctgtaatgataaaccacctggtccaggacacccaggctggaggcggcatccagcgtatggagattgaacatggtatcctccatcctgcgaagctgcggcaggaaatacaattgattctttttcaaaaaaccggttctgtagaactgggtgcataccgaaccaaaacagcacggaaggccgcagtatgtattgtccagcagtcctaaacccaggtcctccttaccatccgtatccagcgccagccagcctttagggccatatccatgcaataccgaggcatgggccatgttttcttcataggcaacgtacaggatgtccggattgtatttttccaatatgtcagccgcacctgagagtgcatttaattcaatccagtcgtccgggtcaataaaatatatccagtccccacccgccctgcgtatgccttcattccttgcctcagatacccctcggttctcctggtgtacaaccatgatacgtgaatccttattcccatagctgtcacatacgcttcctatatctgtagtggatccatcatcaataaggattacttcatagtcaccttcataatcctgtcccagtatggaatccatacattgatgaaaataagccggatccgtattatatacaggtaccacaagagaaaattccattttcatttacctttcgcactcacatattccttaagcatcctgacagccaggttcctgcaatagatgaattcctctgttctataaaaaaggaccacattcagggacaccgatacaatacacgccaccataaaatacacccacagccttccatatggagatgccgatatcatcatatggcagaggagtttgctgatatacagccctgcaaaggcagccgcggatattttaatcagaagccattgataatgtgccgcatccaggtacaggaattcccggtacagcagcctggtttttaatatgatctggatgattaacgtgcacgtggttccaagcatgattccaagtatgccccacttaagccccagcacaatggagacaaccaggtttatgctgcttcccagaatcgatatgttcttatccttggcaaacaatcccgacaccatcatcatccgccacagtggctccctgaccacaaaataaaagaaattcaccacaaaggaatactgtaggatatcatccatcagatatttcctgccaaacaggatttcaacaaaggggtccgacatacaaaggatacaggcggagcagaatgtggttaccaggtatatgataaatgtcatcctgcataggacctggtggcaccgctccctgctttctgacacagccaggttccctatgctcccggccgccgcatcgggaatcataagcaatatcttccgtacatttgatataattaatgaataattggaatacagaccaacctgcagtgtccccaccagaactgatatcagtatgttatccgtggagttggtgattttcccggataaggtcccaataaaaagatgtttcatattggcaaaaatctttttcttttcttccgtgggaagcctgtccctttttttcaaaaaaggatactgtctgtccgcaatatgggcaatggccacattattggccagggtcacacctacgtccgacagcaggtatgcaatgaaattatgggtcagcatcaaaaccgccagattggaagccaccgtaatgaaacggaacagggtattggcggctgaaatcaggtacatcttctggtccgcatccagaagggtccgtttgtatgaaaaaaagtaggagctgactgtcttcagcaaaaatatcacatagacaagcctaagatatccaatgtcaaattccgcattcctaatcaggcatgatacaaagggcaggaaacataatccgaccgccaggatgaatcctgctatgagccggtatgcacttttgtaaaaccacatcagctgcgtcagtttctgttcgtcctgtcctgccagtggtttatagagattatatgttatggcagaacccacccccagttccgcaagggataagacggcgattacttctgtaaacaaaccattgaggctgaccgctgaaagccccaggatacggaccagggcggttctggtaaccatactcaaaaggacggtcaggattacgttcacctcgccgtaaactatgttacgtatacttttttctgttctcatatggacaccagacatacttttctaattttgatgttatcttattttgtttttttcctctttacctgtccgtagacgcgtatatgctcatccaccgcatgatcccagctgtacttttcccttacaaatgcaatctgtccttcccggtcatgaaggcttacgtcctcacccagcatccgttcaaggcatgactgcagcatggctgcatttccttttgggaagctcatggcgaatccccctgaaacatcaacattttcctcaatgtcactgaccaggcaccggacgccatagctcatggcctccagaaggctgatggacatgccctcgatatcgctgggcagcacatatacgcagcaattggccatcagttcctccagcacctgcccctggacaaagtcagtgaacaggattcttgggtcatctccggccataccgcgtatcaactttacatattcattgtttttcgtcagttcacctgcaattaccagccgcttatccgtgtccatttttttatatgcactaatcagataatgcaggcctttctccggcaccagcctggacaggaaaaggatataaccattactttccagattccatctgcggccaatctcctccggctccggacagggtttcaggttcacaccgttggggatatagattgtctcccgcccatatgtatgcctgaaatactgctggttcccatttgacaatacaatcagggcatcggaatagcgcgccgcattcccttccccccacaggaggtagcgcgttgcaaaccggccccacttggccctctgccaatccagtccatgtatggttgatacaaccgggattcccagccacctgggcaggaatgtcatggcgcaggggccttctgcatggaagtgtatcacgtcataccggccaattaccgcgcgcagcacggcaagcacggaatagatgaatgcattcagggaggggttcgccaaggtaggtatccttatgagccgtattcctttatattcccggcgcgggcgcattgcccccgcgccaaaatcctgccatcggttatagcagtcaacctgatgtcccaaggctgtcaggcggaccgacagttcctccacggcaatctcaatcccgccttccctggatggtacccgtttgtgtccaatcattgcaatcttcatgctgtcccgctcccctccatcctgtacagaattccatgttttatcttatgctgcccggatgcttaatcgcactggaataaatctcttgtatatacctttccccgtacatctgccagctgccggtcataccggttagccaaaatcacatccgatatctgtttgaattcctccaggtcacggataatcctcatccctaaaaacgaatctgctttgactgcaggttcatagatgaccagctttacgcccttcatttccagccgcctcatgattccaaggatggaggaatgccggaagttatctgaatccgctttcatggtcaggcggtaaattcctgcaacctcaggggatttctttaatatctgccctgcaatgaaatccttcctggtctgattggcccttacaatggctgtcatgatgcagttgggtatattaccataattggccagcagctgctgtgtgtcttttggcaggcagtatccgccatatccaaaggaaggattgttgtagtggttgccaatcctcggatccaggcacaccccgtttatgatactttcagtatccaatccgaacgcctccgcataggtgtccagctcattaaaaaaagccaccctcatggccaggtatgtattggagaacagttttacggcctctgcctcagttgggcccatatagaggatcggcacctcctcctttaaggaagcggcttttagcaggcctgcaaatatgcgggccttctcctgctggacgggattgcatgtatccaggcccacaatgatcctggatgggtacagattatcatgcaaagcccttccttccctcaggaactctggtgagaacaggatgcagcctgtccggtacctggcctgcatctcatcggtaaaccccaatggaaccgttgactttaagacaatacaggcccttggattcatacgcattaccgtgtcaatgaccatctccacagaggatgtatcaaacctggactgttccgtatcataatcagtcggggttgctatgatgacaaaatcagcatttccatatgcctcctctgcatccgtcgtggcaagcagattaaggcttttttcttttaagtatgattccagttcagaatccgcaaccggggactgcctgcggttaatttcatctaccctttcaggaagtatgtccactgcatacacaggattgtactgagaaagcagcaccgcattggacagtcccacataccccattccggccactgctattttcatctgtttttccatccgcccgcctcctttgccacatcaataggaaacagtagcctcgggcgccagtatttcagccacctcatcggaaccataggtgaggatcttcccgcctgagccaagaacccatttctggtcattcccgtcagttaccttggtatttttcatgattttcccgctggaattaaccagccgttttccttctcccggtatgtcaaatacttcatatcttgccgaggaatctgctttctgaatccttcccttatagtaaaatgccccgtccttgatgccggtgattccttttcccttaaggtcaaaataatattgggaacgggtggcccctatgccgtcattcagcatggtcttaccagtgatacatttccggttcccgtccggaccaccgcaataatagaattccccgttcacatctataagaccatattgtgcagccccatacatgtcaaagacatagtagctgtcgtggattttctcaacggcatagctgttttcactgccgcatttcggttttcctgactggtcgaagtaataccattccttttgcccggtactgttaaggtccactgggccgtctatttttaaccatgtcccatctgcccgttccccctggaggaatgtcttatcctgttcggattccggctggtagaagtaacggtaaccttttatctccggcgttgttgtgctgagttttacccagccctggtgcatgatacccttttcatcaaaacagtaggttactccatccaccttgacttccctttttccactggaggaacgcttcttatttccgttggatttactaaaataaaaataagctgactggccgtggtcctgtacgtaatccaccacatccgaattatccatccagctttccgggatttccagccactgccagccagttaccctggctccgtccttcccacagtaataataagagtattcatcatcgtcatcatccgctgtctctgtcagccagcctgtccgcatgacgcctgaagtattaaaacaataatgctgtccgtcaattttataccagccatccatgcgcacatatccatcatttgccgcatagtaccagttattgtaatctgaattcctggagtccaggccgctgatgacgaaccactggtcctgatataagtatccctcatccccaatatagcgtctcttaccgttttcctcagtcagccagcgtttccggtaattaaggccattggcgtcaaaataatagcgtttgccctccagttccctgaaaccgcctttaaatacggaaccggattcagatgcataataccagttttcagttatggctccggtactgctgttggtatattcaagcttaaaccagccgtcatcctgaaggattccattttcatccaagtaatacctgtccccattcccgtctgtgtaccagcgtttccggtaattaagtccattggcgtcgaaataataccagttcccgtccaactccctccatccattgcgccataacacgccattggtatcagcgtgataccagttggtatactcctgtccattgctgttggtgcctgtaatggaaaaccacccactctgccgcgccccgttcccatccacataatagcggtcatcccccagattgaaccatctgctgcggtaagctatgccataggcatcgaaatagcaggtctttccttccaaatcatgccacccatcctttaagacggaaccatcttccgtgacataataccagttggtataaggctgtcccttgctgttcacattgtcaatggaaaaccagccaggcgccttcctggcgccttcctcatccacgtagtagcgcttatcctcaagattgaagaacatttttctgggggaattgccccactcatagaagtaataatattttcctcccagttcataccagccattcctcagtatcttaccgtcagcccccgcataataccagttggtgaccggctttgaggaaggcaacgcgggattggaggtggtgctgaaccattggttctcatatcttgtaccgtcctcttttaagcggtaccgtccatcgcctgaattcacccagttgttcttaacaatctgtccatttccccctacataccgcagggttccgtctgcccatgcaacccactgattcaccagtttcctgtcattttccttataaatccattcctgggcagaatcctgctgccatccgtccaaggcaaatgcggatatggacgggattgtcacgaatgcggcggtgcagatgatgattggcatgattttttttctcttcataatgtaattactccttgccggaaactactccacagagcgttttcatagacgccttcaacggttaggtgtttcaatgcctgtctgacagactgggcatcttcctcgtaagtaaccccaaaccatctgccattggtcttaagaatccttacccttgcctcccctgactttaccagcttatctatgacagccggcagaagaaactccccgctgtcctgcgtactgtctgtaagatcatctaaaaatccccggaattcctgttccagacacccgaaaaatgcagggtatccgccccacatgttcatggatacatattgatccgctgttatctgcatatcccttattccatcatgaaggatgtctccattacagcccatacggacattgggagtctcaaccacgcccttcagtagtccattatcatctaatatgcagatacctctggtaaccccgccatttacagacaatgtattcttcagacggaaacctgccatacacatttcatattgataggcaccgtcatgattccccaccagaaattcatggagtttttcaaaggcttcactcccataaaaatcatccgcattaatgacagcaaaaggttccctgactatatccttacaacataaaaccgcctgaccggttccccacggttttttccgcttatccggtacaatgtatccgtcaggtacatcctccagttcctggaatacatattctatatccaccagtcccttaatcctgtctccaatcgttttttgaaattccttttcaatctccttacgtatgataaacactactttattaaagcctgcctgcactgcatcatggatggaataatccatgatgatttccccggaaggaccaagctttgtcagctgcttaataccgtttccgaacctgcttccaattccagccgccattataattaatgttgtattcatctgcctcatttctttccctcttagtattgtcttagcatttgttaacctgattctcctgcagggaatgcttttcattatatgagttgtatatcgcatttaaatatggaactgcctcagatgcccacaaatattccggcatatattttcccgtataggcagtaatgtacgtcctgttttctttcatgaattcatagtagtcacagataaacagttctgtgttgactgagtataccccgggcctgtggaccaacagtccttcacatccatactcccttaaaatctggcgcagcctgtacccaatgacccttatattatttttggctgttctttccggtgtattgctgtataagatatacgctatctcggaaagaggtacgctgcctcctcttttgctgaccaggagggccaatagttccttcgactttttgctggaaaaatagactacctgattgtcaacgaacagatcaaaaccgctaaaggtctgtatgaaaatatgactgtctgcagacatgactgtcttccctcctctcttgtaccaagtcttctgttacccgctactccacggtcactgattttgccaggttccttggcttatccacgtccagtcccttagaaagggatacataataggccagaagctgaagagggatgacaaccagactgggataaaaacattccaatgtcttgggaacgtatatggtacaatccgccgtgtcctccatgctgtaattcccgtaactagtaatccccaggatatttgctcccctgcttttgacctccaccatgttgctgattaatttttcaaacaggctgccctgtgttgcaataccgatggtccatataccgtcctcaatcagggaaatggtcccgtgcttcagttctccggcagcatacgcctctgagtgcatataggatatctccttgagttttaaggaaccctccatggaagccgcataatccaggcctctgccgataaagaatacatcattgttatgggaaaacttattggcaaaccattgaatccgctctttttcctccaggatccggctgattttatcaggaaggagtaaaagttcctcaatcataccttgatatgtcccgtcatccagttttccccttacccggccaaaatagatggccagtacatagaccgctaccagctgggcgctgtatgccttggttgtggccaccgcaatctcaggacccgcccatgtgtaaaacacataatccgcctccctggcaatggagcttcccaccacattgacaatccccatgaccggaagtccctggttcctggcctccctcaatgccgccagggtatccgccgtctcccctgactggctcaccacaatggcaagggtgtggtcctcaaacacaggattcctgtagcgcagttcacttgccagatccacatccacaggtatccgcgccaactgttcgaaaatgtattttgcactcatacacacatgataggcggaaccgcatgcaaccatctggattctctttaaaccgcatatttcctcgtccgtcatctttaactcatccaacacgatctgtttgtcttttatccttgggctcagggtgtcccgtactgcctttggctgttcatggatctccttcagcatgaaatgctcaaacccattcttctccgctgcttccgtgtcccagtctatacgggaaaattccggctccagctcatcctggtcaatgttatataaccggatgccatcctttgttatgctgaggatttccatatttttaacaaaacagatatccctggtataattaaggatggccggcacatcggacgctatgaaattaccgcagccggaacgccctgcaatcaatgggctgtctttgcggacagcgtatatctctcccggcctgtctttaaacaggatgccaagggcataggatccgcggatccgtaccatcattctgcttatggtctcaatgggattcccgttataatatttatccaggagatgggccagtacctccgtgtcagtctgggaaatgaattccacaccgtttttttgcagcttatcttttatttcctgaaaattttctatgattccattatgtactaccgcgacccttttatcccctgcacagtgcggatgggaattggccaccgatggttccccatgggtggcccatctagtatggccgataccacaggtaccggccactgcccttccattatccgtcatttcacacagaacctttaagcggccttttgccttaaccacttccagtgttcctgttccatcctcttccttgccctctggcctgcccgccaccgcgattccggctgaatcataacctctgtattcaagccttgccaggccgtccaacaggatgggggccgcctgcatatctcctgcatatcctacaatcccgcacatgctacaatacctcctgatggcctttggatatgatgacctctatgatccggtcaacgaattcccggcatctggccggttccgctgcctccaccatcacccgcatgacaggctctgtcccgctttcccttacaaggatccggccatcctttctcagagccgcttccacctgattaatagcatcctgtacatccttatcctccctggctgccttcttatcctttacccggatattcttaaggacctgcgggtagatatgcaccggctctgctaacttgctgagaggctgttttttctccagtattacctccatcatcttgatggctgtgaggattccatcccccgtggttgcatatttgcggaagatgatgtgaccggattgttcgccgccaatacggtagccgttggaggccatattctcatatacgtatttatcccccaccgctgttttctcatattcaattccggcctcatccagggctttgtacaggccgaagttggacatgaccgtggtgacaatcttattaccctggagttttccccgttccttcatatagcggccatatatgtagaggataagatccccatccactaaattgcccttttcatccacacacaggcaccggtccgcatccccatcaaacgcaaaacccacatccagtttcttttccttgacaaaccgtataagtccgtccatgtgggtggaaccgcagtcagcattgatattcaggccgtccggttcattgttaatcacataggtggttgctcccagggcgtcaaacacgcttttggcaatcatccaggcgcttccgttggcacagtccaggcccaccctcatattctcgtaggaacgggttgccagggaaataaggtaacccgtatagcggttcctgcctgccgcatggtccacggtacgcccaatctgttccctgactgcaagcgggatttcacctgagatgccatcgatgtaggcttctatcttcaggatggtatcctcgtccattttttctccctgggcattgattaatttaatgccattatcatagtagggattgtggctggctgatatcatgacgccgcagtcaaagccttcggtgcgggccgcataggaaacgctgggagttgtggtcacatgaagaagataggcgtccgcgccggatgccgtaagcccggcggccagggaatattcaaacatgtatgaagaacgccgggtgtcttttccaatgacaacccggcatctcttatcttttttatttctgctgtagtaccagcccaggaaccggccgattttgtatgcgtgttccactgttagtgttttgttggcttcgccgcggaagccgtcggtgccgaagtattttgccatgatttttctccttattgtatgcattttataattatgaaacggacttacaaatcacatgatatagtgtcctaatatcctaattaattattgttggtgtatcttctacatacctccattaccacacacccaatcatacagcctattccgttatgaatcatatcatcccattcaaataaacccctgcaaaataccagctggtatgtttcaattaccgcagataccacagtttctatcagcaatccttcccaccatcttatattaaaatccaacattatcggcagaagtaatcccatgggaatcagaagaacacaatttaacaggttttctttaagcagttcactatccccgtttaaaaccttcttccatgaccagaacaactctaacctatactgtcgttctgtcggtatccgggtaaataccgcggaaccaaatacaattcccggaaataaaaaaaggcctattcacggaccgcccacgtcctgctgtgttttatgcgaatttgatataaatccaaacagttttgcctctctcccgtaatatctccttattatctttcctctagtccctgcggaacacatccctcgtatagactttttccttcacatcatccaactctgtatcatacctatttgcaataatagcatcacattgctgcttaaaccttccaaaatcattgactatttcagacccaaagaatttcacaccattttccagcgttggctcatatacaattacggttgcgccttttgcctttacacgtttcataaccccctggatagagctttgacggaagttatcggaattagatttcattgtcagccgatatactccaataacaacctctttttcgctgttttcatcccatgagctgttttcttcgtaatagcccgccatatgtaatacctgattggcaataaaatcttttctggtacggttactttcaacgatagcagacatcatattttgaggaacatctgcataattagccaacaactgcttcgtatcctttggcaaacaatagcctccatagccaaaagaaggattgttgtaatgcattccaatgcggggatccagacaaacaccattgataattgcctgtgtgtccaggtccttcatctccgcataggtatctatctcattaaaataagacacacgcagggcaagatatgtattagcaaacaatttaactgcttctgcttctgtgaatcccataatgagcgtaacaatatcctccttgaccgctccttcctgcagaagctttgcaaaagtaaaagccgcttccgtgaggacatcatctgtttcatctgtccccactataatacggcttggatacaagttatcaaaaagtgctttggattcccggagaaactctggactgaaaataatattctttgtattgaatttttggcgcacggccgcggtatatccaaccggaactgtagattttataaccatgattgctgtaggattcactttaagaaccaattgaatcacggcttccacagcagaagtatcaaagaaattttttttactatcatagtttgtcggtgtcgcaataactataaaatcggcatccctgtaagcctgtacgccgtccaaagtagctgtcaaatccagcgactttgtggaaagatactttttaatgtactcatcctgaattggtgaaatacgcttattaattttctccaccttttccgggataatatctaccgcatatactttatgatgctgggatagcagtgtagcaatggaaagacctacatatccggttcccgcgactgcgatagtgtattttgtttttacttgatgatttatttctgtcattgccttactcctccttgttctttcccctggtaaaattcgtgataccactgtgcaaacttatgcaaaccgtcacgcaggcttgtgctcggcttgaatccaaaatcacgctccaaagcacttgtatccgcgtaagtcacaggcacatctcctggctgcataggaactaacttcttatgcgcctcgaagtcataatcctccggcagaacacctgcgcctaacaattcttgctgtaatatatctatgaaatccagcagattctccgggctattatttccgatattatacacacggtacggcggaaccggaagcccatcttcgccgtttactttctccggtgcacactgcatgacacgcttcacaccttctacgatatcatccacatatgtaaaatcacgcatacaattaccgtagttaaaaatccgaatggtctcacccttcaaaagtttgttggtaaaaccaaagtacgccatatctggacgacctgccggaccgtagactgtgaagaaacgaagtccagtagacggaatattatagagttttgaataggcatgtgccagcagctcattagatttcttcgtagctgcatacaaagataccggattatctacttgatcatccgtactataaggaaccttcttattagatccatacacagatgaagatgaagcataaaccaagtgctctactcctgtctcgccattatcataagaatgacgacaagcctcaaggatattgtagaaaccgattaagttcgattcaatatatacatccgggtttgtaatggaatagcgcacacctgcctgcgctgccaaattcacaacggctgcaggcctgtatgtactgaagatatcatcaatcagagctttatcagcaatagaacctttgataaatctccatgtggaatcggaagctttagctgttttctcaatctgctgcagtcgatacttcttgatagacacatcgtaatagtcattcaaattatcgattccaatgatattaactggtgactgcgtgcggattagttctaaaactaagttagatccaatgaaaccagcggcaccggttactaggattgttttattttttaatggggtattaatcgttaacataaagtaactctcactttctttctcgtttgatatgccatttattttttcaataagtttgtcagtatgcagtgctgcattattctcagatggcttcgcatttgcctaaattttttttaatcagtttataaatcgtatatcccagtaagcatcctaatgtattatgcaaaatatcatcaaattcaaacaagcctctcctggtaagtaattgcatcacttctataatcaaagatactaaaaaaccagataatgcagcctgcttgcaggttatctggtcaaaaccaaccggcagcagcactcctagaggcattaacataagcacattcagaatattttcgtatataaagattgtatttcctttgtaaatctccatataactccaaaaaagcatcaactcatagttgtgccctgtcggtgtcctcgtaataattgtaaatgagaaaaccaatgtaaggtatgctattatcagtcccatcaccacggattttcttttgtttttacatctgtaatttccaatcatcgcaacaattaccccaaccgtcagtgcaatcaaatagtacactggtgaagatagcacttgtgctgtaattatatatttaaacatacgaacgattataccggttcaaaaaaagtatctggtctctgcggattgaatatctcattgcaggtcataaccgttaccaggttctctgtctcactcaggttgataatattgtgtgtccaaccaggaatcatgtggatagcttcgattttatcgccgcttacttcaaactccaccgtctctccagtgttaatattgcgctcccgaattatcccatgaccggcaaccacaatgaataattcccacttgctgttatgccagtgctgccctttggtgatgcctggacgactgatgttgatactgacctgtccgcagtcctcggtgtgaaccaattctgtgaagctgcctcggtcatccacattcatcttcagtgcatacttgaatttctcggtaggcaaatatgttaaatacaaactatagagtttttttccaaatgagccttccggcatcttaggtatcataagcgtctgcggctgctctttaaactgccgtaataaatccacgatttcaccaagtgtgaccttgtgcgtaaccggaacacagcaatatctgccatcgccctgcaacactgtttccacaccatcaaaatcacagtgctgttccttaccttccagaagatcatacattccctcaacaaggtcatcaatgtagagaagttccaattctgtgcttctgtcgttcacagtaaattcttcatcattcgccactgcccagcagaaggtggatacagcagaattgtatctcggcctggaatgccccatcaggtttgggaaacgatatactgcaacctttacgcaagtttctttggcataatcaaagaacagctcttccccggcctttttagattgaccatattcggaattgccaaaacgtcctgccagagttgcctgtatggaagaagacagcataatcgttgctttattcttatgcttcctcaagttattcagaagatcagacgcaaagccaaaatttcctttcataaaatcctcaggattctcagggcggttcacaccggcaaggttgaaaacaaagtccgccttttggcagtatgtatccagctcatccgccatggagtccatgtcatactcgtagatttcctcgattttgatatttggtctcgttctgttcttattgtctctaatattcttaagattgttcacaagggcagttcccaccattcccttggcgcccgtcactaatatattcattatctttccacctccttgactgcattttcaaatacagtcaaattatcttcatgttagtacctattcttcgataagaaggtcttgcacatcttttctccacaccatcttgttaatcacaccggtgtagctctggataatcttaattaccttggaactcacattttcttcgatatagtccggcacgggaataccatagtctccagctttattcatttctacagcggtatcaacagactggagcagacccttctcatcaataccagacagaataaaacaggccttgtccagtgcttcgggccgctcggtactggtgcggatgcacactgccgggaagggatgaccgatgctggtgaagaaactggactcttcaggtaacgtgccactgtcggatacaaccgcaaaagcattcatttggagattgttataatcatggaatcccaaaggctcatgctggatcacacgcttgtccagttggaaacctgaatactccagacgtttcctgctgcgcggatggcaagaatacaggataggcatattgtacttctcagccatcttgttgattgcattgaatagagacatgaagttcttttcagtatcaatgttttcctcacgatgggcggacagaagtatatacttacacttttccagtcccagccgggcatggatatccgatgcctcaatctcaaccagattattgtgcagcacctccgccatgggggagccggtcacgtaagtccgttcctttggtaatccgcagtctgcaagatagcggcgggcatgttcagaataggccatatttacatctgagatgatgtccacgatacggcggttggtctcctccggcaggcactcgtccttgcaacgattgcctgcttccatgtgaaatactgggatgtggagtcgctttgcgccaattactgacagacaactgttcgtatctccaagcacaagaacagcatccggttggattgcagccattagtttgtaactctgtgagattatgttgccgcatgtctctcccagatcttcgcctactgcattgagatatacgtctggatcagcaagttttaagtccttgaagaacacaccgttaaggttgtagtcatagttttggccggtatgggcaaggatagtatcaaaatatatacgtgtcttattgatgacggcggctaagcgaataatctccgggcgtgtaccaacgataatcaacaatttcagtttgccgttatttttccattggatgttggtatagtcattcattgttgtttaatcctcctttagtgaatatcatcctgcctcttctcatcacgagaaaagatacggttttcatcaatgttcgttttcagaaaaaggttgagaaccacattgccagaagacttagggcccccagtaatcatcaacacttttcctgcaagtaaactcattgtttgtttcttcattatattatttaggcagattgcaaactcaacagcacccaaatttctgctttttttcttcctctatgcgtcaaaagcgatttatatgaattttcaaaaacagtcgacaaaatccctgttttatgtaacacagaggttttggaatcaattcatcaatgaagcatggtatggatagctccctagtatcgtgttaaagaaaaatatgaggactcattttctcctcataccatagtactgccaaataaatagctgctcatgtgtgatatataaatggtattaatttctcgtattttccttattcaaaccgcatttaatagtaaacatagccggatactataacaaatgaagaattcataaaagaagaaaatcaaactcccaactattcgaatgccaggtatgactctacgcttatatgtatcgcaccctccatctccacatacgaatatctaacttggtatgttttccaacccatatcggaagtttaatagcatttataaatttttatgttttaaagtttatatataatgttttcaatatgcttatttgagtcaacactctttttacccataatactcatcatagcctttcaagaaaataaactgattgaatgttgtccttgaataatcgcctacttcctaatttctttcatagctcaataaacatatttattttgcaagctcgtcctggatatatgccagagaagcaatcttatcccttgtttgctcaaccgtcagcaactgtgtattattagaattaaactcggtaagaatatttcgttttgtatcacccttattgaaatacttgtcataattcaaaccacgcttgtcgcagggcacacggtaaaagttacccatatcgatagcatgagcgcattcttcgtttgttaaaagtgtctcgtacatcttttcaccgtgacggataccaataatcctgacgtcctctttattgccgccgaataactcacacactgcctctgcctgagtctgaatagtactggccggggctttctgaacaaggatgtcaccaggttcgccatgctcgaaagcgaacagaacaaggtcaactgcctcatccagagacataataaagcgggtcatggcaggctcggtcaaagtgatgtgattaccgtttctgatctggtcaatccacaacgggataacagaaccacgggaacacataacattaccgtatcgagtgcaacaaatctttgtcacattggtcgttctcgcttttgcaacgatgaccttttccatcattgccttagaagcacccatagcgtttacaggatatgcagccttgtccgtggataaacatacgacatttttaacacctgcttctattgcggcggttaaaacattctctgtaccaaggacattggtcttgaccgcttctatgggaaagaactcgcaggacggaacttgtttcagtgctgctgcatggaatatgtagtcaactccgttcatagcattcttaacagatgcaaggtcacggacatctccaatgtagaagctaatcttgtctgcaacttccggcatttccacctgaaattcgtggcgcatatcgtcctgcttcttctcgtcacgagaaaagatacggatttcaccgatgtccgttttcagaaaacggttgagaactgcattgccaaagctaccggtccccccggtaattaataatgttttatttgtaaataagctcatattaatctactcctttttattaatgtactgtatcaaagactttatcttctcttctagggtcatggactcccacctttattttgatctctcaccgaaatcattgtgcaccccagcaaatccgttctataaattccagtaattcttgtacccttccaagcacagtattattaccaataaatagcctttcgggagggggtatgtcgctacctatgcctatgcatacatttaggccacaatgtttcagtctggaacggtattccttcgtcctcattacttcatacaacttattcaatcgaactaaaattatatatatgaattgtttaatcatcctactactctcctactcaatttttcttcttaagaccgctaaagtctcttctcatacttcaaatatattttttttgccaaaatattgcactccttatatcttggtacataattcagcaggaaaagcataactatcgacaacacaaatattccaacagctttcagcatccaatcaatccaaccggtaacaatgattggtttccagaagaaaaacgccaatgttaatattaaaaagccgctgaaatttaacagcagatttttcattaaactcatccagccaattttgcattttcgatacacgaaaagaattacatcctgtgtacggaacaaatacgaacaaatcgttccaattagcaatccctgcatacccaatacaggaagtagtgccagagaaacagacaagttaattactgcttcgattattgaaccttttttggtttccttaaaccatccatatgcattgattgttattaatgccggaaccctcaccagattcatcatttgacaaatacagaataaaagtgcaacagatggcaaaatataatttgtatccgcaaccgaagctgtatataacgaaacaaaggggattgtcatgattaaagctgtagaaagaatcgcaaacaaaatgcaatagaaaaaactttcaaacaacttgaataccttgttataggttttctgttctcctgttgcaagtctgccaaaagttgctaaaattgcttggctgaatgttgtatttataatggcagcaatatttgaatagatataattgtacacagagtaaatactgacattctttaatgttgaggctactgtcaaaatagtgacatctgtatgattaaccacaagccctgcaatctgatgtaccaaaaccgaccaacgctgtaatatcgcctgattgtttggttttgctttcagatctaattttttatagtgtttttttacataagcaaatataataatggacttaataactgccgtagccacaagtattgactgaaccacaatgatactctgattcatgtaaattgctatcaacctcaatccacaagacaataatgtcaatactgagtcacagatgtatattattccaatccgattatctgctgttaacaatatcacgtattttccaagaaaagcataagttatcacactactcagtcccgaaataaaggtcaatagcccagcagttaatgcatcaacctggcttgctacaatacaaggaatcagaaacgccaggcctacaagcagcatcagaaaccaacggcatattttctcatattgttgctttgttgctgctattacagcacttacagaatcccaattactcttcgcaagcggtacataaagtgcttgtatagacgctgtaccaattccggattcaagcaaaatcaaatatgtcaaaaattgtgtaatactggaatagagtccattgatatcagacccaaagcttgaaagtacatacttctgcacaatcagaccagtcacaatcattatcaccttgcaaatgatagataaaatcatattctttcctagatgtttcattttattttcctcacagtatcacaagcacaatatatgccaaagcaaacatactcccatgaaacaaactcaaattaaaaaagtagtacagaaatacaatttttaccatcacatccgtacggcttctctgctggcttctccatgccataactacaccacgcaaaatataagccaaagaaacagccgtaccaataagtcctatttgtagcaataaatctacatacgtattatgagggacaagctctccatttcccgcaaaaagcgaattaaatccgaataataatcccacaattccctgttccgaaaaaatatattgcagagctttgcttaacaattcactgcgtgaagatgtaaattctgccatatttcctaaatttagcaagaaaaacttttcctgcattctgacaatataggcatcaatcgtctcatttcgcattgaatccggcattgtcatatatacatttataataattaatataaaaaatattatgattaatgcattccagattttttttggtattgaatcacgttttataaaaacaaaacaacccaacactatcaaaaatccaatcagacctgatgtagatagtgtaaccgtcattgaaaatactgaacaagctatcatgattgtttttaaataccatttgaaatttgtatcaaacaacgttattgctattcctatatttaaaagcaatgaggaaaaatttgaatccccaataccaacgcccaagatacccttccttaaaaacgctttagaatactcattcagttcataaaattcaacaccgcctgtcacacaagtatgcaggctaatcaaaaatacggtgattgcgatacctttaaagaacagctctctttccttagtttctgacacacattgagctcctgcacatataaaagtcaacgtgtagataatattttttatgccgattatactgtaatgatacaaagtgacaagcataataaccagaatgacagccgctatcatttgagaaatacgaatttgaattctatacttatttaacagaagagccagtcctaaaaaaagtaacagcaaatacgggaacgaaatactaccaaaaaatatacacctcaatgcgtcattggcaacaataataatgctagttacaaatgctttatatccattgaaatagaggtaagtaaaacaaatagccataataggacctgttattgtctgcaatgagggatttataaacacacacagtattgaagtcataaggatagctaatacatagcgcaatctcctatctatctgttccctcgtaaaaaacaataaagctttattatgccctttatccaagtgttccttgtcgttcattatgttttcaggcaaaataatctacctccatattccaataaacattagtatcaatttgcaataggtcatgcataaatttttattcagattcacttcatcctcctgttatctagcttcataccctgaaaaagaatttaaatttcaaagcaatgaaataacagcatttacaatcgcatcattcgcataattgaactcttttgcacctgctttaattttatttcttgcatcatcgtccgaaatatagcgtaaaattccactgtaaatcccatcctcgtcattgtcgttaataaaaccgtttacaccgtctttaatgacctcttccacagaagaaaatctggtggaaacgactggaatgtctaaagttaaagcctcatttatgaccatcggttgcgcctcataacgtgaagtcatcacaaaacaatccgcttgcctgatatacgggaaaggattgggttttaagccaaggagaagcaagtaatcttctatctttttttccacgattcggtcctttattatcgcaaaatcctctccatcacctatgatataccaaataaaatcgactccttcatttttcaaacgaaaagcaacctcaatcgcccgatcaaatcccttctgagatgtaaatctgcccatagaaataaaagtatacgttcttttttttaagaactcgacttcttctttggattggttgataataaattcccgcggaatagtgttatagattaagtgaacatggctggcagacaaatgcaaatttttcaacatactattttgagatgcctgagatacacaaactatttcatcatactgatcataaagtctttgttcctgttccaccgattttccaatagcaaagcgatgataatcattatgtacccatgcaatcctttttttacaccctatatactgtgcataatcggttgacaaagattcttgatacgcaataacagtatcatatttttcagattgcttttttgcactagcacggaaaaatagttcgacagctttttcttttccacaaattatatggcataatacaaaagtcattctgatgagcaaagcaatgaaccccttacttttcagctgctttttcggacacatgacagaagatatgattttctcttctggcagaacatgtgccacctgttctgctctttcaagaaaacagccttctctttgaaaaagaaataaatctgcttcataccctctttctttaagtaatcccaaaagattaagcatagaagtagcagatccaccgcttctcacggccggtaaaataaacaatactttcttcattgtttcttcagctccctaatgaatcttttcatctcttcccgatagctcatataattaaatgctgtttcagcttcttttcgcgccgcagtacgcataatgaatttgtcttccgcatgcatcctcaacgcttttctgaagccttccgcacatgcttctgccgtctcatctgacaccacaatacctgtctctccgtctctaatatatagatttaggtcgctggtatgatttgcaatcacaggagtaccacacatcatgctttcgccaacctttgtgggaaaaccagcattagcatagcgaagatttggtctcaatagaacagtaaaatcagcacttgctattttctcctgtacatctacatacggaattcgaccatgaacaaatatatttcctgttaattctgtcatcatttcctcactgattccaagcttcagcaactgattcttatttgctccatagagatgcaattcgatttgatttctttcttttatagtaagcaacaacaacgctctaattgcgttagcaatatagtcctttctggctggagacccagcataagcaacaattactttctcattatgattatattcgacaaaagaatagtgtttcttatcaataatagtagggatacgaaccacattacaatttcttgccttatagtactctgtcaacaaagaagaaattcctataatattcctggttttcacatgttgtatgataagtccatatcgattatatagaaaattgatttttccccctaatcctctgaacgaattattatttttctgataccattctacagaattataaattattgcaacatgtttctctttcgcaaaatccatcaagaagctaatactttgaaatgcaaaattactcgcaacaatcttatcaaaatgatatttttcccatgattcagttattgctttcagcacaagctgttctaaatattttttccttttgaccttaggtacagataaataagcagaagcgtccacattggcgtatttcaaaccatctatctctccgctaagaattgtccctttatcatatcttgttccaatcaatattggattctcgccgcaattctggaataattttgctaaattaatgattctagttgcatttgctgtctggtctggtaatgcttgtgcgcctataaataatacactcataatctgcctatctcctaaactatttaacatccttcataagaaagttttcccattggtcatagatgacgtcctctgcaaaaacccttgccctgtttctcgctgataccccaatacggtcccgtttttctcttgatttaagcaactctctcatggaactttgcaaagcctctgcattattgcagggaaccaaaagtccgttgattgaattttgtattagcatctttggacctccacatggacaatctgtagagattaccggtgttccaacagccatagcctccatcagagcattgggcattccctcaaaatcagatgacaacacaaagactttcgcagttgccaatttttctggcacatcggtaattaatcctggaagccaaacacgttttgaaagattgttttcttcaatatattgttcatatatttctcgcaaagggccatcaccataaattattaacatatcatttggaaaatctttttcaatttctttccacgccctgagcaacaacagatgatttttttgctgttcaaatcgtccaacggtcactacatcctgcactggttctattcgatttatttcgtaaaactttcttcctaccggattcataatgacagtggatttgtctcgtactgatttttgaaaataagctgccgcatcctttgtctgaaataccactccgtcagcaaaagagaataacgttcttgcaatccagttattaacttttccttttccatactcatgaacaggttcatttctaacagaaactatctttttacatttcaaaccaagtgttgcaagcaatattcttttatttggattgcccaaaaacgataaaaccacatccggctgttctgtttttatagtcttgcgcaaatcgaaaatcctgctgatgtttttaataattggatttccttcaagagatttcctcaggtatatccttttaacagtttccggtatgggataactgtatttttgttcatcagtaataaaatcattcaccaagacaacatcgtagctttcattgaaatatgtaaccaaattagacatcactctctgagcaccgccacgataaagcgtgtcaatataaaaagcaacttttttcactttgtcattctccctagcaaccactcacataaatcacatctaaataggcttttctaatgtttgccttttttgataaacaactgttttaggcggtacatctttatttatcactccccccgctgcgataacagcgccctcaccaatcctcacacctttaaggatgacacaatttgctcctatccaggcaccttttccaagtctgattggtttagtggtgtatccaccacatccatcgtgatcatggtcatatatatatgtccctggtccaatcgtaacattatcctcaatgtcaattctttcatgtgcaactaccatactcccacggttgatgaagcagccattgccaatagatacgcatccatgtttcgcttttatctcaactccaccactaatccccgatttgttaccaacagatacccttccaccgccttccgtatagatgtatgcaaacggactaatcagattaatccatccaaatttcactcgacatcccaggattctctttatccatagttttattgttgatgctgtcatagaaatagctatccgaatatacttcatccttatctccctatctctttaaaatctctgatggaataatactactattttttaattcagctaagaagtaccctcctcgttcaatctttcatatatatttatatacttatctactacaatcttttcgatatagctgtttattactttctttctattggtagaagaacatttcattctcatttgctttcccttcattctctcaatcgcacttgctgccgcctccgtgtcttttataggtaccacacagccgccatcctcaccaatcatatctttatttgcagcccagtctgtcacaatacatggcaaccctgccgccattgcctcacaaagggaattggaaaatccttctccaccaaaatatgtgagaaacataaaaatatctgcattttttagttcctctttcacacccgccttatctttcggacctgtaaacacagtatttttcaaccctttgctttttgtatactcttcaatcgctgtatcaactcttccaaccatccgaaactggatattcgggaacatttcggctacggagataaaatcatatgcaccttttgttttaacaacaccgccaacgtataaaacagttttaatctcatcctggattttataatcatctgcaatttcatcctcggatataaaattaggtatcaactcatacggcgtgtctgttatattatcaaggtaatcattcgtttgggtgttaagggtaatgataaaatcactctttttgcatagtttctttaataaaaatttccctaatctactcttcgtagtattcggaactgtacatcggaaatgaataataaacttcctgcctctgcgtttcgttatacatgcgcatacatactcccgtatcatggacagtgtcgccgatgggatgcaggaatgaacgatttttacctgttcatctttcagttcacgcttaaggccagaccaaattcgatggcatcgcttgatttcatctacaagattcctcctgctttctttcttcccgccgaacacattgcgttttccaatcatcttctcatcaacaactgataactcccaaccgttctttaattgcgccttcaacattctctgtgtccaactcgctattccgccgtatggcggcggagtcggtgccaataacactgttttcatataatttctccaaccacttttataattgccccttcttctttgacccaacatttccaactattaggtatgagacagtcgctatgccaatcgtcactattaaggcaataaagaagtaaatccaacttcctaccaatccaagttcaatcaatatatttacaatcaccatgtggtaaatatatatcccataagaaatatcatcctttatattcagtcctggaaatgcataagcaaagccaacccatgtcacacctttgagaattgtttgtaataatccatatcctgcatctatatcgaagcctgtgaagataactgcaagcaataatgccaatccaacccaccagaatttctttaaaattggcataatctctttaaaataattgcaaagcaaagcccctgtcatgaaaatccaaaaatatgggataaatgttgcttcatagagtttatatattgtctccgaaagcaatttttccaattgaggtgaaccaataccaatggcaaggcttatagctatcgttacaaaccatctttttttattttcgtggcttagaaatttctttataacccatgctacaatgtaaaactgaacaatcactgtaatagtccataatgacccattcggtgtgccacaaccaaatcctcttaaagaatccggtgtccagaactgcattattgtggactgtgtcactataaaaagcatcaagtcttttacattccacctatcatataagaaaaaaatcgaaataatacttatggtaatcgcacaccataattccggatagattctaaatattcgttttcttacatatgtcttaagattcggagttttctcaattgaattccaaattagaaagccacttagaatgaagaaaatcggtactccctgaaaaatggacattattattcctgcaacacttgtcccactcaggttcatgtgcactacggcgtgtccgtagaacacttggattgctgctaacaatcggagtagattaagagagttcttttgtatcccccccccccccaatcaggcctattttttattagattcatctcattcattttctacctcattcactgttttcatccgacttctcacaatccgatatcccttctcaaccatgtaattctcctaagttacataatatgttttataatttctttataacttgctgttgcactacacgattctaaaagatactgtcttgcattaattcccatttctatgcgcaattctgtactattaacaaatcgattgacattttcaacaaatgcatgcggattattgcttgcattccataatccaatttgattttggattagtatatccttgaaatctgtatgttcatccgttgctgcgattatcggctgtgataaatcaatatgtccaagcatacgtgaagggatatttggaactgtaaaattataatccaaaaaaaccattccgacatcgcatgatgccattaataaatcatagtcatactttggtatatacgacagtatttttacattttcacagttattttttttaatttctttttttaaatcatcaaatgtattcccacttccaacaaatagaaaaaacgcatcgttgcattcttttaagtgttttaccagcgaaataatatactctgttccttgagccctgctaataacgccaccataaataaatacaaccgcatccttgggaatttgatatttttctctgatttcatccttatgagaagttaattctgcaattctctcatttgacgatggaatgatactattgggacaaatatccaccatttcttctgtaatgcctttattcaatttaagaatgtattctttgtttccttttgacattacgccaatactatccgaatacctgtacatcgacaattcgcacttttcaaatatcttgtacataattgaatttttactcagaatatttaaatcaacagcattttccggaaaaaaatctttatgtaaaagataaatatatgtccctttttttttcaatattttcattaccggcgcatatgttatgggaagtgtcgcaaaaattgcaatatcataatgattttgttttaaatatttataatacactttcttgaaccaaattaaaaaccataatgttgctatccctttttcaatcaaagaaactttgcctcgaaaatttaagcttttaactctaaatacattaatatctccattttgtatacaagtagtactttttttatatttacgttcaatgggtgtaacaacatcaacatgatatccctggttttcaatttcttttacaagatcgaaatacagattcccatatccatcttcgggatatactgaagtaaaaaaaacaacattcttcttatccacaatccatattcctttctactgttatcaaggccaatgtctcgctaattttttctgcaatcttctcaccactcatgtcgtattcatttcgcaaatacttttgattaccaactttgacacagtattggtcattcacgccaattctcaacaattttgccttggaaggattctcagccataacttcggcaaccgcccccccaaaaccgccgattacattatgttcttcgcaggttacaatcaattcatgttctgtcgtacacttcaaaatggttttaaaatccagaggcttgacagttgggaaagtatatacagtcggcacgaggtctactttcctcaacatttcacaggcagtttcgacttcctcaaaaattgcacccgtggatagaattgccacacgttcacctttatgaacagaaatcgcctttccaatctgaaagttttcaatgctcttatgaattcgcttttcaccgccacgccccaaacgcagataacaagtccccggataattgattatcgccttcgttatttcttctgcttctgctaaatcaccgggacaaaataccgctacatctggcagtgctctcataatcgcaatatcctctgttgcttgatgactcatgcccagagaaccatacacaaaccctccgccaatgcaaacaatctttacatttgcatgatgataagcacagtcatttcgaatctgttccaaacatctaagcgttggaaaatttcctatggaataggtaaatacagtcttaccttccaaagccattcctgcagcaaccgtagtcatattctgttctgctattccggcattggtgaactgattcgggcacttctcccaaaatggctttaatactccaaatcccaaatcacctgtgattaattcaatatttttattattctttgccagttccactaatgttttgacaaatgtgtctctcattgtttaactccaatcattctatctaaaaacttatttttaggcagatatttcatataaatctcatatataatcagtggtccaagtaagactaccagaaacatgcaaggataagtcacataccactgaagttttaaaatgaccaccaccacaaactctgttactgcttgtatcggccacgagtatatgtatatcgtaaaggcatgtgtcccaatatatttgattaccctcatttcatgctttgaaagtacaacagctaacgtaagcatcaaataaatcatcaaaacccctgtcagcttatatccgacagtgccaaaaccatgcgcatataaaataaatgcgactatccccgctacggctcccgcgtaccattgaaataatatttctttatttttgataatgaaatctgataagaacattccaagcaatgcatatacaaattcaatcgagatatcttctattgcaaaccatctaacaggaatagggtaaaatgttaatataatgcctaaagaaatccaccccccccccagcaaatcttaatgattgcggacttattcgtaaaatttttgtatagacaagcacataaaagcgtaatcaccagatatacaggaataaaccaaaaatgcccccaaattccctctctcggtatcagcagcatccccacaaaatttgttgctgagatttccatattatcattcatgtatgcacccagagcacattttggcagccaggcagccagtgtgagaaccacgtatggcaatatcagtttttttactttaagcttccaccactgtccaatatttctgttattagctgtatatgcagtcaatattcctgcgataaaaaagaacaagggcatatgaaacatataaacaaatgtcgttattctctgcaaaaatcccggataatcggagtgcagaggatgtgaatgtccaaaaacgacaagcaacactgcaaatccatacaatatcgttatgaattcttggctcttctttttcattgtgctctccctcattccatctatactctgtattctctttcaccacttccagactttgcctctactcgcctcattttttccggataagtggtcttccaggtatatgtcaaggtatggtcattattgatatcgtcactttccgttggcaacacaggatttggaattccctccggggtgtatgggtcttccaccccctccggtttcgtctggtgcagctcgtttactgcacagtcatattcccatccatcatgtggaaatctataatgccacaggatatcattttgcataaatgagattccgcatcctttgactgtattggcaagaatcatcatcggcttatgttcactttcttttccattttcttttgccttctgaaaagccgctttgagttcttcgtgattatttccgttgatttcaatcacattccacccaaaagctctccatttgcttccgaaatcttctatttcaagcgtattttcctgaaaatccaagctctgcatatgattatgatccacaactgcaatcagattatttaagcgaaaatgatttgcaaagagtgctgcttcccatacagaaccttcatcacattccccgtcaccaagtaccgcaaatactcgacctgctttttggtcctttttcagcgcatatgctatacctgctgcagccgacaaaccatgtcctaacgaaccggtagaaaaatccaccccaggaagatggtgggaaacatgcccggataaacgtcccccattctgataatgggtttttagttcttccactgggaaaaaaccactttctgcaagtgcagcatagattgctgctcctgcatgtcctttgcttaaaataaccctgtctctgccattccattttggttcttccggtttgtagtctaaaatatttgcatataacactgctatgatgtcagccacggataatacagctcctatatggcttccgccagataaatgtgtcatttcaatgccatgacgcctgataagccatgctaatttttcacttttcataccatttctcataccgtttctcccatatttacttgctgtccattgctatattcatcaacaattttctgaatatctttaggtaatttctgtgaatgcgtaactaccttgtataccgtataaaaaatacagtatatgtcagaaaagaaattatggtgatatctataataaagctgcaattctattttaaggggtcttacacattccatataaaattcatctgggtcaacggcagcagtgaatcccttaaactgttcaaaattggccatagaagcccaatccgtaattccaggtttcaaatcgagaatcggcatttctctatttgtatacttttctacataaaaacgtagctctggacgaggaccaacaagactcatatcacctattaagacattaaacaactgcggtaattcatctactttggtttttctaaggaagtgaccgatttttgttattctgtcatcatcatcaccaacattccatttgccctttccttcacaatctgctcgcatactcctaaatttaaatattctaaaatcctttccattcttaccaactctcaccccgcggaagaatactccaccgggtgagtcgctgacaattagaatggaaataatcaaaagaacaggcgatagaattatcacccctatcaagctgcatataaaatcgaaacaacgcttcatacatacctccacttaaaaatcttttatattgaaaatgaagcttttacatattagcaccatctaccggaatgtttgttgcctgcataaacgaagatttatcgctagccataaatacgatggcatttgcaatttcttctggtgttccaaatctatttgctgcctgatgatgtttaagaaagtcttcaaccctcggattcttttctttcacaaatttgtcccaataactaccggggaaggccacggctcctggcataaccgaacacatcaacacccctgttggcgcaagttgtctaccgactgttgttatataagcatttaaaaatgctttggctgatgcataaagaggatttccacgcaacataactgcagagatagatgatacatgaatgacccttccagttcctcgctcaatcataggggggataaacatactattcatatcaatcgccgcaaccgcattaaatttcaaggcataattccaatcatcagcccctcccagatgatttctgctaatcaaggaaccaccaacattatgaacaacaacatcaaaaaccccgtacttcttaaggagatttctagcaaatttctgcgtattacattccataatatcgcaaactacggtctcgcacattggggcaccacacttaagtgcttcttcctttaatcgaaggagcaattcttctgaacgtgctattgctacaattcggcactcctcagcagcaaatcctaaagcgataccttttccaattcctttacttgcaccaacaataagtacaagcttgccttttaagttgagatccatagttttattccccatttcattttatattcttaatagtcgtatccgatttagcgcaattcatatgtaagtatccgcagaacaattgcccatttggcatttgaatagtcgtcacctttcttctaacacacttatagtattcttcgtcctcctccttgattgttctctttgtaaatattactcttccagtttagattgttaccactgcacagatgccccttacccgcaatattcgcagatatgcgttcacttccttaatagccgtgtatactggacgaataagcacatataatacatatgaatactacgatgagcctgtatccgtcacacagtgttttcggacgcaggcatatgtcaaacctccttatcagatttttccgctctttcgattgggtcaatagaacactcaaaaagccctcttgaactcattggttccggctcttgaaatctatatcccatcgcaaaaatttcataagaggattcaactcaatccgctaaagcccttgtaaaatcaaggcaattcttggttattgctattatatccccatctcccactatgggcaggtctcccttcaggatatttataagtttgggtagttcacccaaactagtacttcgcaatttcctgacaaagtccataagtctcatctcatctggcaaaagatttccattttcatctttcctgtcagtcattgtccgaaatatattgagagtagatatcctgtcatttaaccctggatgttcctgcttgaaaaataccggtgttccaaactttatacttacatcctatcttctcacaggtaaggtgttccacctctccagttcttgatagatatggtatttataactattccctatgcacaatctccaaccctatcttcacatccatccatctgccaaacatctcaatccgaatcactgccagtcgcttatgtctgtcaatatatgtaatctcaccttcaaattttgacaagggacctgacgttatgataaccttgtcaccctctataatccccttggacatttctgctatatgggcgctcccccccatcttctgcaaaataaccttttcttcctcttttataggaacaaactccattccatctccaagaatttttgtaagccccggcacttttttcagttcccagaacagttcatccacctgttctgtaacaagaaaaatatatcccgggaataaaatatattgttccttatgccattccccttgataacgtttcatacgctcgtagtatggaatgaaacattccttcaaaacagatccatctatcatctttttactcaactgaagaactgcttcttcccttccggtcctcacctgcactgcataccagcgttccatccctaccctccaaatctgttcctggatttaattaaggattcttttctgcaacgatattacaacctgaattagacagtattgattaaaaagggcatgcttcgccattccatggacatcccaataccctgatccaatctaaggtatatagctgttctttccacagataaacttcaacaatataacaggtatgacaccagaatgcggcaaagcgacaattctgctttcataccctttcccctacttgactcccagattatacattgctattttcttatgtactgcaaacctttccggattcaaaggtgtaactgcagagtcccggctggcagctgcctctgcagctgcaatgtctgaatccatattcttataatggtattcaggtaccagttcatgcacaatccatctcacatttgctgtttcactaagggctgcctccccaagccggtttaacgccctttcaaaccgatcataatccatttcaattggttttccaatgaatatcctgtcattgaccgtcttttgcaatccttcttcatccatgaggagttcttcatacagtttttctcctggacgcaatccggtaaaacagatatctatatctttgtatggctcataaccggataaacggatcaggttctcagccatatccagaatcctgaccggattgcccatgttcagtacaaagatttctccgccctttgcataggcgccagcctgaattacaagacttactgcttccggaattgtcatgaaatagcgtatgatatccttgtgcgtaactgtcaccgggccgccgctttcaatctgctgcttgaatagcgggattacacttccgttgcttcctaacacattgccaaagcggaccgcaacaaattccgtactgctcttctgattgctcatctgaaccaccatctcacaaaggcgcttacttgcccccatgatattcgttggattcactgccttgtccgttgagatgagtatgaaacattttgccttatatttaatggaggccctggctgttttataagtgcccaacacattattcttgattgcttcattggggctgtcctccattaaaggcacatgcttatgggccgctgcatggtagacaatatcaggcctgtatgtacggaaaaggtaatcaagacggttcgtattgcgcacagagccaatcagtaccaccaaatccaaatggggatacttacgttttaattcctgctggatttcataagcattattttcatatatgtcaaatatgataagctgttttaccttatggcctgccagctgcctgcacagctcactgccaatggaaccgcctccaccggtgaccagcactacttttcccttgacatagcccatgatttcatccagattaacatttaccggttcccttcccagcaggtcttctatttccactttccggagtcttgaaatcgtgacctcgccattcatgatctggtatacaccaggaagtattttgacctggcatcctgttccctggcagattttcagaatatcctttatgtcctcaggagaagcagtaggaatggccacataaatctcatcaatttccttctcccttacaatccttgctatatcctttcggtcaccaacaatggatactccgtcaatgacccgtccctgtttatccttgtcatcgtcaatcaagcagacaggatatccatggaccttttcactggctttcatttccctaagtataagcgttcccgcttttcctgcaccgattatcatcacccggggcggaatgcttttttcaaggaagcggtttatcctgtccgtaattttctgaagtacctggaaactgacccttccactcatggtcgctccggacatcagcacaaaccacagtacataatagctcctgggcatacgcgcatcaaataacaaaatccctacggactgcgccaaagcagcaaccaggcaagccagcaggacctgcatcatctcccggatgcctgaaactccccacatgatggcgtaaaggtgtcccacataaaatataagggacaccacggccatctgcaaaagtccgtacttccatacctccctggcatactcaatggggaccgaggaaagactcaggtcaaatcttaatcccagggccaggcatgcgcaaatccataccatgaccatatcataaccccaaagtatccacatcctcacctttttactgtggggaaggtatttttctaatacaagtttgtttttacctttcactttcacattccccttttgtgccgtaattcagggcgtcatcgtttgtatattacagaaagcgtacctgagttaggaatattaaaccaaatcatcttggacgctgcatcaatcctgcttggctgtattacggtccaggtgcctgtcaggttattgtaaaagagtacctgcacttcccccagtccatcaacgagattcggaacatataacgggacttccaccggtcctgctttctctgcattggtcactgcatctttcgtcacaattgcatgggtccccaccaacgcgttatatccggttaaatccacatcagaaatcacctgattcagtggcagcccgctgtttataccattaatggcatttactacggtctcaggaagccctgatacagctccgccgcttccctgtacaaactcaagtgcagtatttcccacaacagcctgtcccctactgtttgttgtaaccgttgtttccccaactgcctggccaacgccaattccaaccgcattggttccctggcctgaaccggttacggtagaacttcctgctaaggtgcctccacctaacacactgtctaccctctccccaatgtcataatcactatcccctccaccaattaccgggcctgtaccgggactgatagcggcaaaggaaatcactgcctgtgatgcagcaagtgcagctactaacgcaattgttgtaatcctttttctcataatctttacccttcctttcttgaatgaaattaaacatttataataagtattggttttcatacctattttcctttatacatgccgtccgtttcctctctataaaacatatccaggataatcggctggatctgcggtttatcaggatggtattcgtcataaataggggtctccactgcctttcccggaagtgtcagcatatctgtcattcccagttcctggcctcctcctaaaaaggccaaggccatgtccatatacctgtcttttgtcatgtcagtcaccatgtagggttccatctcctttaacagtccggacacaaagctgtcatctgttcctgactttatctttgcagcctgaagcagcccttctatataagacttctggcgttccgcacgtcccaatgcactttgggcctggccggtatccctgtaacggatatacgcctctgcctgcgtgcctttaagcgtgactgtctttccgtaaatgaattcaggatccacccgttccatcccctgttcctccacggtaacggtaacgcctcccaccccatcattcatgattggaagggcagacatgctgattgccatgtacccgtcaatcgccagtcctcctaacagattgctcactgcctccttcatataccggcagcttttatccctgccatctccataggcataacctaatgcaaggtgctgtatatccctgcccaggacattgccgcttaaatcagtcagggttatctccgtcatggtatcccttggtatcatcaggattttaaccttatccctggctatatcctgggcaacaaggaagattgcatctgcctggcctccggccccggcaaccatggtttcctccagacttccaggcctgtctattcccatgcacaggattgccttgacataggtattgcggcggaaaatcttaccctgatactctattctatctatcttactttcttccccatcaaagtcctgttcctgatgccactgcaggacatcttctgccaatgctcttttttccaaatacagctggcctgtccggtaaagaaaaaatgcagtaagaaccgatgccaatgccaagactgcagccatcctttttttacagttttggaaccgaatgttttttctccgtctcatattgtcctttatctattgttttcctcagcctgattttcgccccccccccccatcgtatttaccataatatttcctataatattttttataatatccattttcgtagtccatccccacccggttcaggaccgctcccagaatacggcatccgctcttttccaattgtgccttcactttctgggccagatggtaactgattgtaccgctttcgattacaatgaccgctccatcacattgaccggcaataatggctccatcaataagatttgccatgggcggcgtatctatgatgatataatcatatttctccttggctttttccaataattcattgaataatgggtcttccaaaagttctgccggattgggggaatatggaccagccagaatcatgtcgaaattctccacatcagtggcataacagatatcatccattgtcttctggccgctgagatattgggacagcccgctggggttacctttaatttcatatctttttatgaatacagatttacgtatgtccgcgtctatcagtaaaaccttttttcctatacttccaaaggatgctccgacagaaaaagtgatttcactttttccttcattgggcaatgaacttgtaaacatgattgttttcaggctgcttccacaaaactgtaaattagtcctcagtgtcttgatggactcttcaaaatgatagtccttctcacctgtattctgcagattcaaaatttgttccacgtcttacttctcctctcagcctttttttgcctggtttttccgttttttcctgcttctcctgccttcactgccctttgccgggtcatccttttcctcgctgttattctccggaataacggccagtacgctgatgccaagataacgggatacatcttcctctgaacggatggtgtcattcatgatgacctgaagcgcaataaatccacatgccgccacggataaagcaagacctcccaaagcagcgttcttctttatgttaggggaggtggggttgtcaggcacgacaccattttctatgatttttggcggtatcatttccatgatatccccaatatagtctgaggatgcctttgctactgcatccacaatggcttttgccctgaccggatcagtatctgacacagacatgttaagaattctggtatcggcaggatttgagatgcggatcatactttttaactggttataggataaactcagtttctgtttttcgattacttcttccagcacgggcctgctggtaatcattacactgtaatcctttgtcagctggcttcctatctgcaggtcagccagggaagtgagtgttgtttcctttgacagcacatacaccatggaagtggatgtataaaccggacttaaaattattttgctgtatatccccgccccaagacaccctatcactgctgccaaaataatcatccatagtttttttcttaaagcaaacagcagctcaaccacatcaatctcaattgcatcttcatttctgtcttcatacattttgttttccattacagttaccttttccatactttttcttttgctataacattctgtcctgcaggatgaaccctggattcgtcctggtaatccggtcagatgtccttacccccatattgtgttcaacccacgaaaccgctgtctggatgtccggggaacggtccgatgaattatgcatatccgtggcaataaaatgaatcgttcctttttttaagttttttttgcaccagcgggcctttttatccatccatcccccattcaggctccgggagtttatctgaaggtacgccccatattcaaccagctcctgtgcgcgctcctgttcaaaaaggcatctataacgctccacatgcgcaattaccgggaaataggatgcctgaatcagctggcgcacagccctcttcattctgccaagactatccgacggttcaaactccaccaacacatacctgctgccagccagtgtaagggcccttccctgattcagatattcaatgagattttcaaaatactttatttcctgtccaaggctgacaccaaagccgtctgctatggctttcgcatggtaatccagacaggtgcatgactcctgaagcagccctgtgtcctgattgcatgtaaaatgcggcgtggctataatgtgccggattccctgcccatatgccagttttaataatgttatggcttcatcccaatcatgggctccgtcatccactcctggtaaaatatgtgcatgtatatcaatccagcctttgctaggaaacttcgtattcatcaatacctcttccatgcgcctataaagagttcagataacagctattgttacagttctttttcaaacctggctgccctctgaaatcctttatatttatgcataccacagaataactattctgtggtgcctccatctaaggaaagaccacagaataactattctgtggtacattcctaacggttttagtcataaatgtcattacgaaaatagattgttttaatattctgatacaaacaacaaaataggatccatgccaaaaaggccggttagacattattttgctcccggccttcttgtggtatggaaaaaatagctatatgtatattgacgccaccgacattttggtataaaatacaaacaacactagattttgttaaatcgtgtaactgctaagtaccacagaatagttattctgtggtttttgtctgtcaacttcaatcctcatcttatccatgattttttcgtactgtttaatactggctgccacataaatccttgtggtttcgattgaagaatgtccgaggatatcagcaagatgggacaggttcttttcaatggaataaaaacattttgcaaaaaggtgcctgaaattatggggaaatacttttgatggttggacctgcgcatccctgcacagtctcttcatggaatggtatatattgctcctgtccaggtttcttccgcttcttgtccggaagatgcagccctgtcttatgttggatacttttgtatattcttttaataaacggaccagattcttaggaaagatgattaccctgtattttcctttcatggatatttcagcccttccagtttctatggcttccactgtgacaaagggaagttcactgatccgtatccctgtaccatataagaccatcattaaatagtacaactgcttatttccgtttctgtcggccgccgctatcagtcttttgaaatcctgttctgtaagttcccgtttttcgtctacatatacccgtttctgtacttttaagaatttcaccttaaactccaataaatccttaaattttaaaaatgcgttgattgctgaaagctttccatttacagtctgcggcttgtactggctgctcagatacttccggtattctataagggactccttgtttaaatccatctcctcaatgaagaccagcatctcttttacatcgtgcaggtatttactgattgttgcttcggctttttcttcatttctcaggtagctttgaaattcattgatacatccttctgtcataaacgcctccattgtccttcacatgcctgattaatattcctgataaagttaattgattattcctgattttagtctccctgatttagaatcttttcatactacgcagaatgttttatattgtccgattatttagggctatcattatttccaatcataaccgtacatgcagaatatccgccatgttttgtgggaataggattctcaatatcccaaagcaataacccccctgcaaaaaaagagcctcgtaaagaaacgctctttacaaggctgccttaaataaccacatatcaattgttgtcccccctcaaacgcatcctgacgaacaatacgtagagtgtcctttcaaatcttcctataatattatactcccccgtttcataaatataaatatatctgttacagcgcgattttgctgcatttctaaactatagcgccaacagtgtcaatggtgtatgataaatgctgttttataatacaacgaatagcatctattccattgcagcatcatgaattgctgcagtggaacggatgcttttaataactttcacgtcagagttaatcaccctttataaaaatattaaatatcaacaaagctttttccatctgtacggggattatagcttgattcagcatttcccaatatttatagaaaatatatggattccattaccaaagacataccgatagccaatcacttcctgatattcatcttatgatatttaccttaaatccatattatccaatagaatgcatcaacaatgtatattctgattgggaatccgataatccgtgaacatgaaagcatgggtacatttctggtaaatccatttgtatcatcatatcatatagcggcaataaaatcatttattttcccaggaacatttactgtctcaaatccactttattcaagattcgcatgatactgccagagcttccccacgtcaatccccctgtcctccaccatcatcatggccgtggtgtccccaaacagcagcagggactgttcaaacagggaagtcatgggctgcctcgagcggatttcatcctcagcttttgccctgctctccaccggaatcctgacaaacacatccgccacatccctaagcccgcttctggggttgcttccaatgtgtacaaccgtggcccccagcgcttttgcctttctggcaatgcctgccgggaacagggtttcgccgcttcccgaacctaccacaaggacatccttatccgtgatggccggctctgtaatctcccccaccaccacggtccgtatccccagatgggcataccgcttcgcgatgcattggagggccaggagaacacgccccacgcctacgaagaatactttctcggcttttaatatggcgtccaggtatgcctggatttcatcgtaccgtatggctgccagggcttccccgcattctgctatgactgttttctccatacggttatatagttcctgattaaacatgataatcccacctttcgttctcacttattttgctcccgccttccaaccttattttcaagcaggaaccgttccacttcctttgccgtcggaatggacggatgcccgcctttcctcgtgacacagatagctgccgccgcgtgtccataccttatagccgtttccatatcagcccccttacagtactgcacggccagggcggcgccgaatgtatccccggctgcggtggtatcaacggcgtctacatggtaccctttcacccatttcatttccctgccgtcatagagcagcgctcccctgcttcccagcttcaggagcacatacctgggagccgccttctcatagagccatctggcagccttctccgtatgcgccttcgtgtccggcacgattcctgtcagcgcagctgtctcagcctcgttgggggatatgatgaaaatccccttcagccgctccaggggtatggacatggccgggccggcatccaggaataccgggattcccctctgcctggccatcccgtaagtctggtaaaccgtctcaaggggcatctccagctgcatgaccaccatgtcgaaatccacctggtccattgccctttcaacatcctccggctttatatggtcattggcccctgatgcaaagatggaaaaataatttccgtccgcgtcaatgttcattgtggacaatcccgtaagatgtccctcatccctgaccacaaaggatgtatccactccagcctcctccagctgcttcataagcgcccggccattgtcgtccgtgccgatccgccccaccagatacgcatctgctccctgcatggatgccgcgtaagcctggttcgagccttttccgcctgtaacatattcataacctgtacagtaaatggactcgcccatcttcggaatccgctccacattgtacatgattaaatccatattcatgcttcccacaaccaggatcttaggttttccttccttcatctgactcccctcccctatggctgcacgccttccgcacattttgcttttttagaaaaatggaagatatcggactgcagaccgatggataccaatatcaatccccccatcacaatgttctgccaccaggaatttaagtttcccgcataattaaatatggtgttgatgatggaaatgatgaggatgccgaaaaatgtaccgctgaacctgccctcgcctccggacagcttcaccccgcccagcgcgcacatggcaatggcagttgtctcccatgcgtccccggccgtgggctgggcggtatacagcttggaggccagcagcatgccggacagggatgcaaagagtccgcagattgtaaatgccgcaatcttcaccgtatccaccttaagccccatcatcctggacgcctcctcgttgccgcccaccgcataaagcgccatcccaagctttgtccttctgctgacgaacatacaggccagggtaaggacagccaatacgataatcaggatatggattccaaagggccttgagtcccccagcagggatatggccggattggtgatgggaatgggttttttggatgtcatcagcataatcataccccgcactgccagcatcatggccagggtggcaatccaggatgaaatcttcatcttagccaccatgaatccattcaggaaaccgcatgcagcgccggccagaagtcccagccctatgcccaggagcatgttatcattgccgaacattgccataagcacgccgcccagcgccagcacggaccccacggacaggtcaatctggccaatcaatatgacgaaggtcattcccagcgccaggaaaccgccgtcgctggctcccttttttaccaggttctggaccgatgcaaaggataggaaatttctgtccgcaaacaggataccggacaggatgaacaggataaaaaacactgcaatggtacttttggattgaatcaactggtctgttttcttcttgatattcacgtctgcccctccttatacggacctttcccgctgaatatacaccgcagccacgataatcacggccttaaagatattggcgtactcatatggaatgttattcatgttcaccatgatggtcagaagctgcatgatcagcgcgcccaccacggtcccgaatatcttcacacggcctcccgacatactggtcccgcccactgcaaccgcggcgattgcgtccagttccgccagacggcccagggaattgccgtccgctgcgccgattttagcggttgccaggattccggccactccggccagcacagcgcttgccatatagacgaacatgatggtctttgccccgctgatgcccgccatccttgcgcttctctggttgtctcccactgcctgtatgtacaggcccagcaccatcttcctcatgatgaaatacaccagggcgattaccgccacgatgggtatgatctggaagggcagtattccgaagagtttatagcttcccagcattttatacgcctctgcgtggggacctgttatgttgaatatcttggcatcgtttaacacctgggccacgccccggactccaatcatcagggccagggtgacaaccatgggctgcacacggagttttcccaccatgacgcctgctatcatgcccgaaaccgaacacaggaccagcgcgccaagaatggccgccaacagtccatagggaagaagcttggccgaaacaatacccgccagcgccatgacggctcccacggatatgtcaatcccgcccgtggcaatgaccatggtcatccccattcccgtaaggattgccacacatgtctgcgtcacgatgttccaggccgtccctacgctgaagaagttgggggtaaccgctatgttcagcagcagtatggctgccagtaagataaatgcgctgtatttctggatcattgcccggttatctgcttttgtccttgcctgattactcattgtccccacctcccccggctatcatttccataatgacatcctgccggatttcatcgcccagaagctcccccatcttacgtccgtcccggatgaccaccaccctgtcacagttccgctccagttccgccatctcagaggatatcatgaggatgctgattcctttttccgaaagctcccgtatcagtgcctcaatctcgccttttgccccaacatcaattccgcgggtcggttcatccatgatgataagcttagggtctgtgcacatccatctggccagcagcaccttctgctggtttccgccgctgagtgtcctgattgcctgtccctgtccgggcgttttaatgcccaggctttttatgtagctatccacgatttcagcctgtctctttctgggaatcactccgaaacggctgattttgggaaggagggccacggtcaggttctcgctgaccgacaggtggggaaggattccctccaccttcctgtcctctgtgcagaatcccatctccgaggcaatggcgtctgccggacatctgaacctgcattccttacccatccagtagacggttcctttgtccggcaccgccgcaccgaagagtaccttggcaagctctgtgcgcccggctcccaaaaggccggcaagccccactacctcgcctttcctgatttcaatccccagaccgttcagcctggtgccctgccggattccttccatcttggccaggacctgtgcctgttccagaagatacccttttttcgtccgctccagctgctttgcctccttgccgatcatggctgatatcagctgcctctggtctatctcatggatgtccacggaaccggtcagcgccccgtcccgcaggattgtaatccgttcacagatttcaaatatctcatccaggcggtggctgatgaagataacggctatattccttgccttcagcttacggatgacgccgaagagcacttccacttcctttgtatccagggaagaggtaggctcatccatgatgaccagtttggcgttgacggaaatggcccgcccgatggccaccatctgctggaccgcggtcccatagtcggacagcggcctggtcacatccacatggattcccaaatcagccaggatatgtccgcattcggatatcatccgtttccggtcaatggtcctgtacctggtcatcagttccctgcccagatacatattctcgtacacggtctggaacggcaccaggttcagttcctggtaaatggtgctgattccttcctcctgtgcctccaggacagtccttggattaatatcccggccgtcaaactcaatgctgcccccatctttctggtaaaatcctgtcagcaccttaatcaatgtggatttcccggcgccattttcccccatcagggcatggacctctccctccgccaccgagaaatccacccctttcagggcgcgcacccccggaaattcctttacgattcctttcattgataatatgatttttcctcttgacatcctctcacctctgtctgtttcaatgggaaacctgggtttttatccgtgatttccctgattttgcgtacaaaaaacagccatcccaaattcagtgcttttgtcttaccgttataatcagaatggctgtctgttacttttatagtcctgctccggcgtatcagaaaaacattgtcaatcttatcctattttcaaacaggccctaatatccaagggacacatctgcattgttgacgtcatacagcgtatcttcattgatgtaggaagcttccaccgtctcccctgccgccattttcccaatcaggtcaaatgtcacctcgccaaagtaaggggagcaggaacaggtacacagcagttcacctgcaatcagggcttccatggcatccttggacgcgtccacgcataccacctgcatatccttgcctggctcaaatccggctgccttaatggctgcaatggcgcccatggccatgtctgcaccgtggcagtatacgatatcgatatcattgccctgggcctggagcacattttccatcacttcctgcgccttaggcatgctgtaattagccacttggtcgcttatgaccttaaggtccgtatccgcaatggcatccatgaatcctttctgacgctccgtggtggatgtggctccctgggtcccctggatgatgaccacgttgccctcgccgccggtcacctcgattaccctttgggcaacctgttccgcttcccatacaaagtctgacatgaccttggtggtgtatgcattgcctgcctcgccgttaatggaacggtcaatgaggattactccgattcccgcgtccatggcagatttaagcgcggactgcagcccatcctcctcctgaggagccacgatgatatattccactccctgtgaaaccatatcttcaatgtcagacgcctgtttggcaatgttgccggacgcatccgtataaatcaggtttacccccagctccttggccttctcctggatgctctctgtttccactatcttccagttactgctgttgtcacactgggagaatccgatggtcatgccttccagccccttcccagcctccgcactccccgccgcttccacagcctctgtaccagccgcgttactgccgattgtcccggctgcctgactgtccgtgccggcgccgcttccacaggcacacatggaaatcatcatcgctcccgcaagtaatacgcttactaatctctttttcatttagaacctcctcgattgccctgtttgatttgatagctttattatagcggacacccctatggattgaaattcaatatttcccacacttattttaaaattcagcaatggatggaacgaaaacagggcctgctgttttggtaaaagggatatgctttcaatatttgctgtttttcttttaatattttgcaatgagtagtggatatggcatccaatatggcaacaaaaattcaaaagggtacttgaaaaaatcaagtaccctgtgtataatttacttagaagtaatcaaaagactgtggtgtgtctgatgattgcgcttcggattactacggtaatttatagttacgagctatcctctatggcggtagaggatagctattttctattctgatggttatctatgtaagcaagcgccgcaaatatcaccagcaccaatgtcaacacattctgcgtatccatattacatatcctccttcgattatttccgaaggaaaccatcagactatcctcttacttctatattcaattatacatatatattttagcataaagaaaatccaaacgcaacgcaggatgaccgctcacacgctcatacgcgcatcttcatacgcattcatacgcgtgtttccctcacctacccattcctgtactccgacggcgtcatcccgcacatccccttaaacaccgtgctgaaataagacggcgtggcgtacccgcaggcaatcgccacctcataattcttcatattcgtatgcttaaggaaatacttcgccttctctatcctgattcccgtcagatactcaataaaggtctgcccggtctcattcttaataatcatccccagataggatacgctgacgtgggcataggcggccacatcgcccatggaaaggccttcctcggaataatgctcctccacatactgcgcggcccgctccatgattcccttgtaccggctgccggatatcttctcaaaataggcatggattaagaagcatgcgcggcccagctcctcaatcatgtcattacgcttctttttctcaagaatcctctgataatactgccttgggtcccccaggatttcttcggcgttcccgcccgcctcctccggcagccggatgcattccccatatagattggtgatgatcagcaccagctgcatataggagaggacctgccttcccgacaaggtatcctgcagttcccgcagcgcatcctcaattccctggggacttccgctttttatctcaaagaacaggttttccttgtcaaattccggtaaatcaaaggaagaaaatgcagaaccgctgctgtccggtgccgcaaggctcttcatgaagcggacctcgctgtccttcctgacattcagataggactgatgcagaccttccagccccctggatatggttccaaagaacagttccaccggccctgtctcctcattaaatgtcccaaaggcttcccggacacgtctgccctcctgtttcacctccccaggcgactcaccacagatgcacaggatccgctcccccgcattggcgcgcagcaccgtaagtccgttctgtccgtcttcgccgtacagcccttttaaggtacggttcacaaaatcctccagactcctgtccatatcgatgacatgcagataatcgcactccatgctgatgactgggaatccctcaatcgcaaggattccggctccataataccggtccagcacaggctcacccagacgtcctatgtaatcccccagctcctccacactgcatttctgcagcaggagctttgtatacatctgctggcggagcgcctgcatgtcctcataccgcatggacttaagctccatgaattcccggtccttcttccgctcttcctcgatttccatgcgcagttccaccacggttttctttagctgttccaggttgatgggctttaagatgtattccgatacccccatcttgagtgccctcctggcatactcaaactcatcatatccgctgatgaccacaatgcgtatcccaggataatccgcctttaatttctccgccatatcaatgccattcagccgcggcatcttgatgtccgtaatgattacatccggcggattctgttccaccagcttcagcgccttttcgccgtcccctgcctccccgatgatttcataacccaggtccgcccaatccacacaggttaccagccccatgcgcagaagttcctcatcttccacaatcattaatttaagcattttgcgctgcctcctccttcttgggcaatgtgatatatacctgcgtcccctttgtatactcacttctgaaatccagaccatattcctccccgaaatatgcctggatcctcctctggacattgattaccccgtacgcattgtcattgtaccttgccccggatgccatcatggccctgagctgcgccagccgttccggcttcataccaagcccgtcgtcagatacgcacagaaccagccggtcctctgtctcttccccggtgatggtgatggtgccgtgctcatccttttccttaatcccgtgatagatggcattttccaccaggggctgcaggatcatcttaatcaccctgtaccccatcaggtcttcactgacctcaatcttataatcaagtatcctgtcatatcgtattttctggatggaaatgtagctttccacatgcctgatttcctctgccaggctgatgaaatccttcccccggctaagcccgatccgcagaaagcctgtcagggaatcaatcatctccgacaccttatccgtccggttcatacgcgccatccagttgatggaatccagggtgttatacaggaaatgcggcttaatctggtcctggagggcattaaactccgcctgcaccagcttctgcctggtgtccctctccctggccatcaggtcatccaccttatataccatgtggttgaagccatggatcaaatccccgatttcatccttcctgtcctcctcaatccgtaccgagaagtccccatcctccaccttcctcatgccgtcaaggaccctgcccagcggtccagcgatgttcttagccccaaaccaggccatgaacagggatgcgccgccgaaaaacacaatgaaaaccaggattgtgttgcgcatcacctgggcctctgcatacatatccttataagatataagtcccagtatcttccagttgctgtcagacagcggaatcagctctcccagatacttcctgcctccgatattaagttccagggcatccccctcatgaaggctgtcctgccctgcaatgcttgcattgattgtccctatatcttcctctgacagttcatcattattggcatatatgatcctatcgtcttcgtttaagatgaaggtattcccgccgaaaaccatctccccgtcctggatggacttaaggtcttccaccagcacgtccaccacggtgacgcccagtatatccgtggatgccttatcatgtatgggcactatgatgctgatggtcagaaggttcaggttgttggccacactggagccttcatgaggttccatccataagggtttacctgtctccatcacggtccggaaccacggctcgtcccggtactcctccttatgaaggctgtaatagctgcggaaaatagccccgttggcccccagcacgtaaatcccgttgatattctccgaactcctccaggtgtaatacaatgaattattgaaattaatccgttccttataaatttctttatccgtatccggcagcggccttcgaagggccttctggatatcactgtcctccgaggtcacctccgccatatgctgggcatccgagaggacccggtccgtatcaatgttaatctggcggagggaattccccaccgaatccgctgtcagacggtatacgctgttcatactgataaaataacacacggccatgctcaccaggaagagcgctgccaggaccgcaaaatagattaaaagtctggcctgaatggaatatttccattttttaaagttccttctcataatcagcctcgtttttctcttgattgttaatcttgatggttatcattgtatcatatcgcgttgtgtctgaccattggatttgtgggaaggatggggcagcagatatctttctttgggatactcctctggtgttgtattttaaatggatttgaaacaaaatgataaaaaaggggaacagcttcatgccattcccctgcatccctatgccatttccctaaaccagatcgcgtttcagcggcagccggtccagtaccttcaggatattccattgtcccaaagatatccagcccttaagcaaacgtaaccgttgtgccatccatcccttccaacgcctctatcgccgtatccaggctggtgatgattgccttcctgtccggatacctgcggacaaatttcatggcggcctccaccttaggaagcatgcttcctggagcaaactggttatcccggatgtattccatcccatcctttaagttcagatggtcaaggtttttctggtcctgttttccccagttgacagctaccttttccacttctgtcaatatcatcagaatgtcggcatccacccgttcggccagcaattcggccgcatggtccttatcaatgacagccgccaccccctccagtgtcccatccatattctcaatcaccggaatccctcccccgccgcatgaaatcacgatggaggattcccataaatccttaatcgcatcaatctccacaatccttctgggtatgggtgaggcaaccacccttctgaatcccctcccggcgtcctctttcatcctgtatcctttttccgcctccagtgcctctgcctcttcctttttataaaaaggtccgatgggcttcgtgggatttgaaaaagcagggtcgtccttatccaccacgatctgtgtggtcacggatagcaccgggtaattcatgttccttttatttaattcatattttaaggactgctggatatggtaaccgataaacccctgggacatggcgccgcatacatcaaagggcattgcaggcgtcacatccctggctgcttcggatgcaagcaatatcctccccacctgcgggccgtttccatgtacaatcgcaatctcatatcctttacagcagatatccgcaatatatccgcatgtcttcttcaccacttccagctggccctctgccgtgggctggctgtttttagactgaagggcattgccgcccagcgctatgacgattctcggcatatcttctccttatgcaatcagctgattcctcttccacccataaagttttccaatgactcctttgcagccatccgtttaagctctccagctacattttccctctggtactgggtaaaatataccagcagtccccgcatggcggtcagacggttccccgcctcctcccagcacagggaggaatccgaatcagctacctcgtccgttacatcctcacccctggtcgcaggcaggcagtgcatgaatttacatccgatgttccccagtgacatcaattcccggttgacctgataatcatggaatacgcggacccgttcttccctcggcatctcattctcatacagtccataccatacgtccgtatagataaaatccgctccccgcaccgaatccctgttgtcggtaacttcccaggtcccgcctgaaaccctgcagtttccttccaggatatccttatactgctcatttaactgatgtgcctttggtccatagtggacaaaatgcattccaagcttggtggtaatgaagccaagggaggcgcatacctgtgtcccgtcacccacgaacacaaccttgcattcctctaatttcttacctcttggcaggttctccatgattgtacacatgtcgccgatttcctgggtgggatggttataatcagacatgccgtttaagaccggtatggaacaggattgggccagttccacaaccgtcttatgttcaatgacgcgggccatgaccacatcaatcagctgggacagcaccttgcccgtatcccctatggtctcatggccgcccagctgtatcatgccaggccccaggtactgggcatgtccgcccatctgttccatggcggtttcaaacgaaacccgcgtcctggtggaggattgctggaaaatcattcccagcgtcctgtttttcatcagcggcggataataaccgtccctgatgcttctttttatctccagggaaagatttacaatgtccaggatttcctctttcgtcaaatcctgcgtgtcaataaaatgtctcaccccatttgcatacatatcgccatttcctcctgattcatcattcatttattcctctatcggtttaaccactgcattaagcctcatagacaaccttgccatccacaatggtcatctgtaccttaaagttgacaatatcatccggctcctcgtatggatcccggtcaaggaccgtaaaatctgcatatttgccaacctccgtacttccccgttccttctcctcaaacgccgcatacgcacagttccaggtatagcacctgattgcctccgtcacgctcatccttctccccggatgggagctgttcacaagggagtggattcccgacaacggattcaaaccgttgatcggcgagtcggaacctccggcaaataccaggccggaatcaatccaggtcttataacattccatgcgggcggtccgctccttgccaaaatactgttccaggtgtccgccgggaaaatcataaaggtagaggtattccggctgtgcggatatgaccagccctaactcaacagccatctggatctgttcgtccgttggcagggtaaaatgttcaatgcggtgacgcaggcccttgtccccctgttccttgattaccctctggtagatatagaggatctggtcaatggcccggtcccccatggcatggaaactgcattgcctgccatccgcatgggctttggacacaatatggtacagctcctcatccgtgtgataaaggaatccccgtgtttccggccggttgtcatatggccggctaagggccattgtccactgtacatcggccccgtccagggtaaggcatccgccatggcgcgggagatggaactcctctgcatcttcatagcgccatatctgtggatagataaccatatgtatgggcatggaatcctgttttttctgccagatacggatatccttattattgcggacaaactgcccttccagcccatggaaacccgtaatccccaggcttaatgcactggcgatgaaatcatccatcatcccttccagatgttcctcgtcaatggtgtccatgatatccatcagcgcgatgaactgggccgtatcggaattaatgatgcccgtgtcataatgcaccccgtccaggtcctcagggaataccagctggctcagtgcccttgtgttcagggtgcttccatgtccgtccagattcaggatcatgactttctttccatgggaaatccggtcgatgtccgtgcgtgtgggaacattaccgccctccatcatcacaggcaggtaaccggatgccaggactaaatcatcctcagaggaagcacagcgttcctccaccagttccaggacctcagccgcactctttgcattgacaagattaacggcgctggccgtgacagcggaaagcgaagcgtggatatgggaatcaatgagaccggtaacgattgtgctgtccggcagattcaggaccgagacaccctccggaaccggacagccggagccgatggctgcaattttcccctgattaacggccacccaggttgctgttggattcgattcatccatggtaatgattttctttgcgttgattaccagatcatatttcattgttcataactcctttcagaaactatagcccggactgctgcgcttttaaattcccggtctccttcactatgaaaccaattgccaggcaaaatgccagtaaatccgacaggaactggctgtaccagacccccatgaccccaaacacggatgagagcaggaacatcagtggaatcaccaccacataccggcttatgccgataatgatggaaatcctgactttttccaccgactggtaataacaggaaataaaatatgcagtcataccaagactggtcagacatgtaaacaggcgtatggcgcgggcgcctgtcacaatcagctctgcgtcgcctcctgcaaacagccgtatgatggccggcgcaaaaatcaccaccgggagactcaccacaatcagcaccagaagatggatccggattcccgaccggagcagttccaaaagacgtccgggctttcctgccccatagttgaagctggcaatgggctgaaggccatttgccatggtctgggagaaaatcatgaccgtataggcaatataggaattgatgatgccaaaggcagccagttcaaggtctgaaccgtatcttcccagcagatggttgatgaccagggtagagatgaagatggctgcctgaaaccccagatacggaagtgcgatcttaaaggatgccgccaccagtgaaaagtcaatcttcaaatcggaaagacgtattttaaatattgtatctctattaaacaaaaagtaaagtattgccatgaaactaagccccagggtacagccataatagatacctgccccaaggatgccgattttcagcaccatgaccccatagtacaggattgccagggcagtcatggacgctgcgcccatggcaaaggaggcgatacccggtttttcgtccacccggagtacagaaccgagaatctgtcccagcacacagaacggaaggccgaacatgaatgccctgatgaaaatcacacattcattaaccagctccgcaggcgctcccaaaaaagcagccacggtcctggcataaaaaaataccagggctgaaaagacggtcatcatgacagccatgaaccaaaagaccgtggagaaggttttcctggcgccttcctcatccccgtcccccagtttaatcgccgcaaggctgctgatgccaatgccaagccctgttcccaaggcaaggtttaaggtctcaatgggcatgacaatggaaatggtggcaaggccgctgcgtcctaaggcgttgccgatgatgattccctccgcaatgaccatgacagcctgggccagcatcccccaaaatgtgactacgctgtagtgaatgaataaggacttaatgtccttcgtgcccatttcccgttcttcctcggaatattcaacggcaccggccactgtaacagcttcctctgcatatgacatggatggacctcctttctattgtctgggggcgggatccggctgctgtaatgccatgcagtggatattgcctccgcaaagggaccattccctggtccagattttaatgatctgcctgtcaggcatcaatttggcatacaggtcgcatgcaacctggtccatgggatccccgtactgtggaacaagcagcgcatggttcatgaaatagcagttaatataagtgactgccagcggaagtcctgcaaccctggacgccgcggcttcacagatatcgattccggcattttcctcctcagtaatatgtaatatatccggaaggggaatcttatggatctccagcctgcgtcccctggcatccgtttcactgctcaggatatcataagcctcctttaacggtttataatgggggttattaacatcatcggtccatgagagggccaccacccccggcctgacaaagaaacacacatcgtccacatgtccgtctgtctcgtcaaatgccatgccgtcctttaaccagatgactttttcaagattcatatattccttcaggtattcctccacctgttccttagtcatatgaggattcctgttcctgtttaagacactgttttccgtgatgatcagggttccctggccatcgacctgggtggcgcccccctccagcaccattttcctggcatcatatcggtcatagtcttccaggtccagcagcttggctgcaaattccgaatcatacttccatgggaaataaagtccgccctccagtccgccgtaggcattccatccccatgtgacgccgcgcatatctcctttatcattgatgacatagaaaggccctttgtcctgggcccaggcgtcgtccgtagacatctccaccacccgcaccgcttccgggagacgcgccctggcattctcatactgaccggatgaacagaatacggtcagcttatcgtattttatgatttcctttgccacatccaccaatacctgctgggccggtttgcccccgttcctccatgtatccgttctctcaggccagattaaaaagtcctgtctgcgtggttcaaactctcccggcatacggaacccgtccttctttggcgtactatgaattattttcatgataaatcccctcctgtccaatttaaatcacttccaaatatattcggtaatcccatcatacgggatttatacgaaaggtacaattacccggaggcagtaccacgaaaattactacctgccataacactttcgttctataaaccttacgtccgtctactccccccttgattgtatttcccgtttctatatgctaaaataggcatatcagaatgggagaggggaattatggtgactttgacagaggaagactggagaaagttagatgactgtatcctgaaaatccataccactgaggcactggatgcgatgcaaagacagtttatggaagatttggacggactgattccaaaccagaagtccttttttgatctgtgcagctgtaaagacggacagttccatttcttccacccggtatccgtaaatatgacggtggagcagattacttcatattataaacagtatcagttctcggattatgtggcatggattttcaataccgaccagcccatcatctacagcgactcagatatcgtcagtaatcctgtccgggaaaattccctgatttacaagcggtggatggaacccatgggtgtctactacagcatggggagcacaatcgttgaacaccagatcatgttcggttcaatcacgctgttcagaagccgtgataccagcgacttcggcgaacgggaaatagaaatcctgaaaatcctgaaccgccacctgtccgccagcttttccatgcgttttccaaatggattaaaaaagaatgataaagaaaccgacaaaagccggatgaagcggtacggcctgacggagagggaggaggaaatcatggagctgatcatttccggcatcagcaatcagcagattggtgaaaaactcttcatctcggaaaataccgttaagaaacatattaataatctgtaccggaagcttgacgtggtcaaccgctcccagcttatgacaaattactataatcaggcatccatgctggtggatattaatgagaggaaggattagggcggttaaatcaaaaaccctataacacaaaacaaacagcaccccccagcattcaggatggtgctgtttatggtttatttcacatcatacagccggattttatctcttgtattgcagctgcgggggattatctcgacctgttcaagctccagaccgtccacatggcggacccatatcccgcatgcgtccacatccccaaaggtgttattttccggatattggtatagatattcttcaatcggatgtgggatatccaacatttcttcattatcgcaatacaccgccttaaataatttcaccttaatatttttaacggcctttcggatgttttttccttcttcgttccgggcctcaaatccaaatatcaggcttggcacttctacccccgtggcatttatattctcaattgtgacatcctctatcatcccaccccaatatcttccgctgccatccggcgtatagccggacttatactgattgcgcatgttaagacataggaataacgggcaaagcaccctgtccatggttatgttacgcacggtaatatctgaaatccggctgccgtccgctgactcgatagaaattcctgatgtgcttcccggataaatatcgggcatgaaaaagcagcagttttccaccagtacattggaaatattgtattttgtctccgtacctatcttaaaggcattcatcacggtaattacatgacagttgtgtatatatatatcctccatgtcccgtcccgtctcctgtgggtttttgagtacaatcccatcgtcagccgtagaaacaaaacagtggtccaattccacatggctgcttcctgtgacatcgattccatccgtattggccacatggcggttattgttgattacgaaatccttcaccagaacatcatcacagcaaaacaggttcagggtccagttcatggcatcctcgaaaataacattttcaatccgtacattcctgcagccattgaaccataccatataatccggtcttgaagtgggtccgattccctccagatacttatcctctgaaaaccgtatcctgcgcctgtagttataacgcagcgctgtttccggcagttccaggtcaatggttccccggggtgccagatggctgtatggcaatggttccatccttggcttcagttttggctcatatacataatattccccattcccgcacacttttcctccccctgtaattaccaggccagaggctccctccgcgcgcaggaacgcccggtccatccttgcgttctccctggtcgctgcaattgctgcgcccggggcaatatgcagcgttgtattatcatatagatacaccgttcccatgaggaaggtcccctcccttaccaggattgtaccccctccggccctgcggcatgcatctgcggcggcctggaatgcctccgtattcagccttccctcctgtgcaacagcgccaaaatcccggatatcaaataccggcttttccggcgtatgctgaggaatgggctgcttaaagtcgatgtatttttcaaaaggtaacccttcatagtaatcccctttgtaaacatttcccaattccgggtaggtcggcgtctcaaactgtatttcattttgtgtcttatccatcaatttattcctcctgccgctattcgtttaactgtgtagataaatgtcttaagattgcctcatcccagattcttacataagaaggcgtatggtctggatttcatatggtttcacatgcaagggaaccgtatccccatccacagccagttcagcctgatcctgctccagcatattgcaccggaacgccgctctgacctgtgacgccagcttaagccggacaacacaatcccggttaaacgcctcataaagtctcacgatgatcccattcccatcatctgccggctttattacctccaggattacattactgctgtccaccgccgcaaaagcctggccgggaaccaccggaccgccgctctcctccttaaccagggcttccatcggattgttgaacgcatatgccttctggatgattccggccgttttccagctgccctcatgaggacacagggaatatgcaaatccgtgatgctccctgtccgcatccggattcggataaacagctgatttgagaagggttaagccgattacaccgtcatggatatcgcatccgtatttacagtcgttcagaatactgagtccataaccgtcctcggacaggtcaatccatttgtgggcacatacctcgaattttgcctggtcccatgaagtattccggtgagtggcgcgttttacatttccatactggatttcataagttgcttctgacgcatggatgttcacagggaaatagtttcttaataaaatctgtttttccctccagtcaatctggtattggaggtcaatgcggtccaattgggaatagaagattaaatcctgttggattctcgagtccagatacatatggaccacgcggatcacagtccgtaccgggccgctttccaacactgtaatctgtgcatccgtatcaatgggatacgctttttcagtataataatcattgatatcccaagcatcataataatgcggacggtcctcgtaagtcaccagacggtttccggtctcattggccttaatcagttcacgtccggtccttttatccacaaatgaagtaaactgtcctgcgcggttcagttttactgtgaaatatggggtttcaaccagctgaccgtcaaatgaaacgccagtctgcgctttttccatatccagtatgctaaaaaccatattcccttttgccgggattacgggcgtgataaaaatcccgttgccatcatgtgtcttctgaatcggacaggctgcgccgcctgaacatgctgacggatttaccattcgctgcggatatggacagaacacaatcccgctgctcccaaaagcattcatgttataaacaatcaggctgccttcttctgcctgtattcttcctgtcaattttctaagcattgcagatttcagggcatttccccgctcaaacagctctgtatattcctttttcgagtcctcataaacctccccgcaggatgaacccggaaggatatcatggaactggttccgcaaaaggattttccacaattcttccagttcctccctgtgatcctcctgttccgctccccacaggcccaaaacagcctccaggccttccaggttctccagaaggaactcgcccctgcggttatactttttgttgcgcgccatggaggtgtaggtgccgcggtgatactccaggtacagctcccccacccaggccggaagctcttttttgccggatacctcctgctcaagcttcgcaaagaattcccctgcggtgctcatccgggtccttaaacagcctggaatcccctgtgacagcctgcgctggttctccagcatttccctggtcggtcccccgccgccatctccatagccaaagcacatcagcgcctggtcattcagttccttctggctataacgctgccaggtgcccttaacctgggatgcgttcaggtttccattgtatgtggtaaaatggggcggacgctttttaccttccaccagcaggctggcattataatccctggctgaaatgaaatgtgtgagtatccgggttccatcaatcccttcccacaaaaaggtatcatagggcatcttatttgtttcattccaactaatcttagtggtcataaagtaacgtattccacatttttccataatctgcggcaaggcagcagagtagccaaatacatccggcagccacagaatttcattatccacgccaaactcttccataaaaaagcgttttccataaacaaactgccggatcagggattccccggatgacagattacagtccgcttccagaaacatgccgccttctgcttcccatcggccttcacggacgcgctgcctgatctgcgcatacacatccggagcattttccttcacatattcataaagctggggctggctggacataaagatgaattccgggtactggcgcatcagttccaatgccgaagaaaagcttctcaccgccttatccctcgttaccgccagggtccaaagccatgccacatcaatgtgggtatgccccaccgtatagacagcttccttttgcctgccgcactcctttttgtaaaactcctggtccatgtaatcctgggcctgcttcaggctgtcaaagaattcctttgagtagggttttctcagatccagaagattcagggaagcggtcaaagcccgccggattaccattgcttttgcacaatccggttccaaaagttccagtacattctggggcacggccaaatcataatagtatttctctatctccctgtgaagtaccttaatccctgattcaagacgcaggcccatgttttgattaccggtaaacgcggacagctgcagccggtaaatatcccctgccttggcactttcactaagaatcacttccctatggttcacatccagtccctgttttaaaactccgtttaaatagacgcggaactggggattcgtcgcatcccagcttccctcacgtccggtcctaagctcataaaccacacatttttcatggaaatggtccggtatcacaatatctgtgcagaaccaataaaaggtatggttcccgccccagacactgtccgctgaaaaatccttccactcctgactcccaatattccctgcgtccttccaactatccccggtacaggccatctgataattttctatggagacagcgtctgaccagcgcagatttcctgtctcttttatcagcttttcgtttctctcatctataaactgcatccgctttccctctcattcattcctcatctttccggagtccatgctgttatccttttaatcccgatgtactgattccctccaccagatgtttctggaataccaggaaaatcagtaacacaggcaggattgataaagttgccattgcgaacatggcgccgtaatccgatgcagcgcccggatcgcagaaaagcttcagcgccaggctcaccgggtacatggcggtcttgctcacatacagcagcgaggacaggaaatcatcccacctccagataaaggaaaaaatacaggcggttacaagagccggcttaatcagcgggaaaatgatgtaccggtacaggccaaagtaagaacagccgtcaatctttgccgcttcatccagttcatacggtatgcccgaaataaagttggacatcagatatacaaagaatccctggatggcaaaaaagtaaggcacgattaaaggcagataggttcctacccagcccagcttctggtaccacaggtactgcggtatcatcaacacctgcgccgggagcatcatggacagcagcatggccgtaaacaggattttctttcccttaaactggaacctggcaaatccatacgctaccagcgaggaggccatgacggtgccgaaggtggcaaccactgaaatcacaagggaattcttaaaaaaggtggaaaatgttacctttccgaatcccttccagccgttcacataattttctaacgtaaacttttccgggatcagggagctggcggtgataaatatggtattggactccttaaaggagctcatgaccatccacagaagcgggtatatcatggcgattccgatggcaaacacacccaggttataaactatatttgataaaatacgttttgatttcataactaaaatcctccctcatatacccagaattttttggttgcaaacagggccagggtaatcagtccaatcactgccagcatgacccacgcaagggccgcgccgtagcctgtattgtagaactcaaaggattgctggtacatgtaaaccgtatagagcagtgtggaatttaacggttttccctctgtaatgatgtagcattgggtaaatgccaggaacccgcttatggtctgcatcaccagattaaagaaaatggtaggcgtcagcagcggaagggtaatcttaaagaaacggtataccgggccggagccatccaccatggccgcctcataaagcgaggacggaatctgctttaacgcggaaaggaaaatcagcatggaggagccaaactgccataccaccagaaggatcagcacccagatggccgtacttgtattccccagccaggaaacgctgcagttgacgcccaccgcctggagaagggaattaattaccccatccgaggaaaacatccgcttccaaagaacggaaacagctaccgaaccgccgataatggagggcaggtagtaagcggccctgtaaaaccctgaaagctttgagttcttaagaagaagcatggccacaaacagcgcaaacagcagcttaaggggaactgacacaaaggcgaagaagaaggtcaccttcagcgttttaaaaaaggttacatcccgcagcatatgcttaaaattctccaatcctgtaaatacaggcggcgagaggatattataatcacagaaggaataatacagggacattcccattggtaccaccaggaacataaaaaaaccgataataaaaggcagtgtaaaaaaataacccgccgtattcttttgatttgccagtcgcttgattctattcatctcaaattcaccctcttaaaagttaatcgggaaaacattttgttttcccgacctctgatttccatggttgacgtattcttattttgacatcatttcattgcctcttgtaaaaagctcattgccggcctcctgggctgtcatctgcccatagcatacctgttcctccaattggttcagcaaatcaatcacctcgctggccccgcttgtggcaggtggattgacctgggaagaattagggcttgccacattatttatataggcaatcatctcctgttccggctggggcagcttggacgctatggcgtccgccacggattgggatacaggaacgccgcgttcacccagaagaatatcgttgcactctgtggaattattaaaccagttaataaacttaattgcctcctccggattcctggcgtccctggaaacgcataaaaactggtttggttttaaataattggacttctttacatcattggaaggccatgtggtaattccaatctcattatcttccgcagaggactccaccagaaccggatactggttggagaaatggaaggtacaccaggccatactctccgggctggttccataaacaagcggattcagctccgtggtcttggtacgctccacaaaaacagagggcgacaataaccagccttctttagtgcccgtctcatacaggtcaaaatattccacataatcagacgcttctcccccaagcctgccgtcctcaaacatggtaatgcccttggaccgcagcaaatattccacatactgctccccgtccccatacgcaatattcgtcttatatccggtcttttcataaatctgcctgcatgcatccagaaattcatccatactcatgttttcatggatgtccacacccgcctgctctgttacggtcttgctgtagacaaacgatggggcggcaattccgatacacagggcatacaggccgtcccccgacttgccggatgcaataatatcctgattacagtccgagatatccagaagtccgctctccacatacggtgtcaaatcagccagtaagccatttttcacatattggtccagatatttgtaatccatctgaataatatccggcagtgaattaccggccgcagcggtcgccagcttattccaataatccgaatactcggatggctgtccgtcaaaggtgatattcggattctgctccgtatacaaatccagcaccttctgcgtcctctcatttctcgtctggttcccccaccaggcaaatataagttctccctcactgctgctggccccattggactttaccttggcctgggtaactgcatccgaagaatctgactgtcccgccgtctgtcccccgccgcatccggcgcatgccataaccgtcatggcagccgccagcatgaatgctgtctttttcatttgaaacgcctcctatgctttgttttgttgactttattttaccaggatgccggatatgccgttagccctaaaaccggctggattgtcccaaaaaaccgacctgttcccaaaaaacagtgtttcctttaccaaaaaaccgctgcctttctctccctggttgcctttgcatttccaatgaattataatgaggttggaatacaagaacggaggagggaactatgggttccatcaaaaaacactttaataacgcatccctgaagaacaagctgttctccattattttgcttaatgtaatcatcatcctgttctgttctctgtgcggcaactatctatgcaccagaatgtacaatgaactgctatttaagacaattgccggcaatctgtccgtttcttcttacagtatatcagaaaagctgcagaacatagaaaccatttcttccagcttgattgccgaccaggcggtccaggaacagctgaccgccctgaaggaatccgacgacgccattgtccggaacaatgccaaccggaccctgaacaccatactgttaagccatttcgcctccctgaaatccagcggcgtggcctatatctccctctataatgacgctttctccaactgtaccaactgggcccttctgtccaaaacagaccctgaaatgatccgggccgccagggaaaacgcggagcatatgggaggcgccgtcacatggaattacagggggcgcaacgattacctcctgctcacaaggagtatcctgaagattgacaacctgtccttctcaaatctgggaagcctggtaatcgcagttgacttagaccaggcggtcagggcatcaaaccaggcgtctgcgctcttcaatggctccgagtatatcataacggaccaggataaccaggtcatctatgcctcaagcgccctttccgacggtgacgccgaatactttatgtccaactcaacgaagccttaccagcttcttacctccaacggccacacctattttacggtcatcggaaacctgccgcgctttgaatacagatacataagcctgattccatttgactccattgaccagtcccttaagcttgccctgggtctcatggttcttggactgattcttggattcctgctggtagtgcttctttccacacgcctaatccgctacattgtagggcagttcaattccctgattacaaaaatgcaggccttccgtgaagataagcttcctctatccatggaagaaaacgaatacagcctgcgcgaagacgagctgggcaagctccaccagcagtttgaccagatggccggccggatacaaacacttgtgaaggttaattatgtcaatgaaatccttacaaaggacgcccggctgaaagctctggaatcccagattaatcctcattttctctataatacactggaatccattaacagcattgcgaaaatgcacggtaatactaccataacccagatggtcagcgcgctgggcaatctcctgcgcgccaccctttcccatgaggaaccgctggtctccctttcctatgaattggaactggtagaatcctatatgaccatacagaaagtccgttttgaagaccgcctgatatatgaaatccacggaaatccccttctgacggatgtctccatcccgcctctcaccatacagcctctggtggaaaacgcgattcactatggaatggaggaaatgacggacgaatgccgcatccttgtagatacccttttggcagatggcaccgtcaccatacaggtgaaaaatcaaggctcctattttgagcctggacttttagaaaaactggaaaaaaaggaaaagcagccaaatggttttggcatcggtttactgaacattaaccagagaattaaaatactattcggagacgcctatggcctcaccctgtacaatgagggttcctacgccgtggcatccattacccttccatatgaaaccaaaggagacgctgatgtttaaactgattattgctgatgatgagcgcctgatacgcgaagcgctgtccaccaccattaactggaaagaccttgatattgaactgactggcatatgccgcaatggaattgaagcttacgatatgattttagacgaatccccggatatcgtgctgaccgacatccgcatgcccggaatgagcggtctggatcttatccggcgtaccagcgaagccggcatcccggttcaattcatccttctgtccggatatggagaatttgagtacgcaaaaaccgccatgcagtatggtgtaaagcactatatccttaaaccgtatgacgaccagcagattatagattgtatccagcaatgcaaaaaagactgctgccaggtccgtttaaacagccgtcccggtatggaacatttcacagcgcaaagcaatatcctccacaatgtcatgtccagcatattcaatgattgtatctgccaggataggcggctggactccatccttgacaattatgaacagtacattgattttcatttcacatcctataagctgctgtacgtctattatctggcatttgagaatctggaacattttcttggccttattaaggactatgttaaaaagaatctgccccagaccattatttatggcgtttatgtaaaccatacccttctgctgttcttccagaatacaggcaataactgcaggcagcttagaactttcatagaacagctttccctgcccgaacaggacgtgaccctggaaacacagctgaccacctactccagcctgaaaaacctgctggaggatgcggtgtgtaagctgaaacgtttcggcatgatttactacatcaacaatttccatgccatctatacctgcaactataacaatgtgatatcacagctgcaggcattatatacccaaatgcttcagggcgggactgactccctggcacaggtagaggaactgttgaacggaatcagcaacatagaattcctcaagcagctgaccggcaatttactgctcaaaatcacagcctcccagccatcccagtccaccctggaactgacaaactggctgattcagctggacagggaaacggatttggcactgcttagggaaatggtccttacaaaattaaaggatatcatacaggcagggctgatttccgcacagtacagctccatgacccagcagatttttgattatgtacataaaaacctgcaggattccaacctttccctgaaggggattgcggaaaatcacctgttcatgaatgtggattatgtcagcaaaaaattctacagggaaacaggcaaaaagttttcccactacctgacggaaatgaggattcagcatgcaaaggacctgatgaaagccaatccttccgcatccatccagaccattgccatgcagattggatgcggaaataatcccaagtacttttctcaattatttaaaaagcaggaagggattactcccactgaatatatgggaaaatagggacaggtacggacaatccatatctcttgtccaatacctgtccgaagaacgtcacatcaaattttttatacatccccctatccgggcctgtttaaccattcctccctggcgtcggagtagccctgaatgcatttaccgtcctatccataatgacctgtgcgtcacttcctgaatcaagaaccgtattttgaaacgccgcgctttccaccagcacggttatcacctcaagttcctgcaattcaccagccgtcagcagcgcccccacctgtgcggagaaacaggagccggcttccggggcctgcgtccccggtatctgcgtgtcctggccctcctgtgtttctgcggcctgtacctccggcccttcagtggtggcaacaatatgattatccgaaatataattccccttgcccgaaacaacgcgtatgattacaggtgctgcaccgtacggtttaatataccgggcatctatggtttctgaaatatgattggcaatgatggaattatggttgccgctgatatacaggagaccgtacaggtcatccaaaccattatcatatccctgcatcggggcccatggttcatggtcccgtaaaaaatgatttgcagaaaccaggttttccgagcatccatccttaaataccagcattcccggataaaatgagtggaagcggttacctgtaacactggaacgcatcacgcctgcaaagtggacactgcttgtgccacggggaaaaatattgttggccgtgaccagaagtcctccaaaattctgggcatagattgaataccctttatacccggcccctatgaggttatcggttatttttgatgcctgccccgaaccgcgcagttcgatacagttgccgcattcagctatgaaattatcatgtattgtcagtgcatccgcgtggtaactggtgattccgtgctctaaatacacaatccccatgcccgtaatacggaaagagtcctgggcgcttgcaatatagatacctgtttttccatttgtatatgtattttccgggtctgcttttcctgaaccatcatccacaaaatgaaggccgtcaatgcagaaatcagcaaactccacggaactgattctgggattcccgctgcgctccacataaaatgcggctcccgcccattccctgtcatccgcctcctgggaaatatccacaagtatgcggcttccgcccggccacagctcatgccaatctgcccattcaccctccggcgtgttgaaacgtatgcttgaagatgtaaaaccatgtccagaccccatgattttcagatagctgatatcgatgaccacctgggtggcaagatgataatcacccggcgggatataaatcactgcccccggctttcctcctccgtcattatcagaatcccgttgccttcttttgatatctgcaatgatgctgttgattacttccccaatatccttatatggattgccaaccgtccattctgttacgtcataataatttatgccagccatatcattccctccgtatcatccatactcaatctgatccgcttctaatcatttcccctaaaacaatccttcattccataggactcatactcccgtattaccgccctgccgccatatgtacggattaaaatccggttctgtgcgtttccggcaaaaatattattggcatgattgtcctgatactcattggcaaaaatttcaagggaactctggtctgataggatatggatatccaattccttttttcctttcaggaacattgtgcttctggaaacgcccctgctccacccatcggatgcattcctgtccacagacatctgcgcattcttaaaatcaaacaggcagactgtcttttttccctcaccgctgcgcaggattaattccagcatatctgcatctgtttcctcaaggtcaatcttcatcttcagttcaaatgccacgccgtccccggctttcagttcggtctctgcttctgttaccacaaacatatcctggcagattgaatcatgccttaagatttctgtctcggcaaccggaaggaactgcaatgttccattctccatcatcctgacttcccttggaatattgaaaaaaccgcaccagccttccttgtacgtcggtccccagtccttccataacggcatccactcccattcattggcccatcctatgatgattcgccttccatccggcgccaggaaggactggggcgcataatagtcaaatccccaatcaacctcaccgcttatataatgactgaacctgcctgtctgataatcaaaatcccccaccagatacacagaggtatgttcacccacacccatgggcgaaaacatcaggacatatttatcacccatgggataaaagtccgggcattcccacatatgcccccattccccgcggctctcggccagtacattgaaaaaggtccagtggaacatatcatccgaccggtaaagcagcgcctgcgccttatggtcgcggcttgcgccgcataccatataataagtatccccatgcttccatacctttgagtccctgaactgattcaccggaacaccttccggggctgtcaggaccgggtttccctcatatttttcaaaatggatcccgtcctcgctgtatgcaatgcactgtgtctgcccaaccccatcgccttcattggcagcccccgtatacatcaggaacagcttgccatcatgctgggccgcactgccggaaaagcatccgccccggggatggtcatcatatgtctcactgggcgccaatgccaatggcagatactcccagtgcatcatatcgtcactgattgcatgtccccagtggatactgccccagaatccctcatatggattatactgataaaagatgtgatatttcccgcggaaataaatcaatccattggggtcgttcagccatccggtctgcgccatgaaatgatagcgctggcgcatttttccatttttcacaatattctttttactgtctatctcatgctgggccttttcaatattctgcagcattaattctttcgacataagactcctccgcttaaccttttactgccccggccgtcattccctgcacaatatacttctgggctgcaagggagatgatcatcaccgggaaactgaacaaaaatgctcctgcacacatgggccccaaatccaaattgtatgccgacaggaatcctgccaatccaaccgtgaatgtctttgcatccgtgctggtcagcagtaacgcaatgaggaaatcattccatgcaaggaacaaggtaaatatgaatgccgtggccaatcccggcttacagattggcaggatgaccttgctaaatgtctgtaaactgcttgcgccgtccacaaatgcagcctcatccagcgttgtggggattccctcataaaagcttaacatggtccacatgacaaagggcatgttaatggcggcatacacaataaccaacgcaatccttgtatcatataggcccagattacaaatcagttcataaatcggcactacgatgcttgaagtagggatcatctttaagcacaggaccagaaccaccaatacaatggatagcttcgcacccgaacgctggattgcatatgccgcaagggcgcccaggaacaatgcgatgatggtgcttgccagcgaaacactcaaactgtttaacagatatttcagcgcatccatcctttggagcagatccgagaagctttcaacggaaaatacctttgggaaaaagcttggcggaactgcaatcacttctgttccgggtttaaatgaacaacaaatgacatatatgtatgggaaaagccagcacacagtaaggattacggacaaactgattcccagcattttcccaatctcacctttttttaccacttttttacacctcctgccaaccgttagcggccctgcttcttcgggttccacaagctctgcatgaataccagtgtgaatatgactaagactgcaataaataccactgccatcgcacttgcataaccggtgtcattataccgggtcagggtcttgtagataatgatgctgattgtttctgaagagcggttgggaccgccttccgtcattgcccagataatgtcaaaggttctggcggcgtcaatgatcctcactgacagggcagtcagtaaaaccggtttgattacgggaagcttaatcgtaaatacctgcgcaagcatacctgccccgtctattctggcggcttctaacatgctggtatccagcccctgcaatccggccagtatcatcagcatcataaacggtgtcgtgagccagatatccgcaatgcagcatgcaagtaaggaccatcgttcgtctgccagccagagaatatcgctgctgcttgataaaatcccaatcctcgtcaaaagctcgttgatgatgccaaagctggagctcatcattaatttccaggtaaggccggccaccaacggcgctatcatcagaggcgccatcatgaatgaacggatgattttacttcctttataatccaattcaaaaaatagggcaaacagtaaaccaaccaccgtctcaacaccaacggctactacaatataaatcaaggtattccttaactgttttaaaaaacctccggcggtaaatgcgcggatataattatccaggccgaccaatgatttactgcctgtaatcccgatttcatagaaactgtcaattaccattgtaatgattggatatatgagaaatgcgcccataaaaagtgcacccggcaggaagaataataataaagtttttcttgaaatcaatctcattcccatttaccaccttttaaaagactatctgccaatttatctgccaattgattcaatttcagtctttgccgcctccaatgtggcgtttacatctgccccgcctaaactggactctacaacgccaatgagaacctcttcaatctgtgaccacgtagtcaccataggtcttgcctgtgactgcggcgcgcttaatgtttcaaggaccgctgctgtatgctcattgccagcttcctttccggcttcttcatatacggaagtccttccggcaatctttaaggtgagattcatgtagtctgcattgtggccatacatgaattcaacgtatttcctggccatctccttattttcggaattcttcatgacacattcataccagggtcctgttgttgccccaatgcccgcgctgccgccaatcatcggcgcacagcctaccttatccgccccaagggcctttactgcggccgggtactgatggctccagttgagctgcattgcggtttttccgttggtaaaaagttcctgggactccgtggcagccgttgccagtgaatctgccggtgtataatccgcacctgcattcccaaccatgaaattcagtgcgtccacatatgcctggtccgtaatgttcacattgccgtccttatcaaacacaagtccttcggcgcctgcctggcatgcgaaatccaggaatgaacatacggcgtcggaaccgctgccgaaaacagtggtgccgctcatgtcgtctgttttcagttccctggcaagggtctggtactcctcccatgtggttgggaccttctcctccggaataaggtcttttctgtaaatcagtatcttcgcattcacccacatgggatatccaaggagattgccgtcgatggtcccgctctcctgtaaggtgggaagaaaatcacttgtatccgcatcattcaccgcttctatggcgtctgcaaaggctgccagccagaccacatccatacaggccacgtcatgtgccgcctgcttggctttaatctccgtggaaagtttgtcatacattcccgtgtaagccaccgcatcgatgattacctcgcacccggtttcttccttaaatgcctctgctgtctcttttgcaagggcttctgcgggggaaccgctttccaccagaaccgtgatgctgttcttatctgctttcctggacccgcctgcgctgttgtttgagccgcatccaactaccattgtccctgccattgctgctgcaagcatgatactgagaatcttctttttcattgttctcctcctctgttttgatttaatgatgaatgactttttacccgggtggaacccgttccacatttgtgaaaaattatgtgccttatttgttttccggaaatggaacccgttccatgtttgtgaaaaaaaataaggcaactgctttatataaacacattatacgccctgttttgcataagtcaatactatttttcacttcaggcttcactttgtttataatacaagaaaatatccaggccgttttgtgcacttttaacattcatactatagttgaccctcctttacgcaactccacttcgaggcttacctgcttatttttataaacttttccatttaccaggttacagacaagccgcacagactcttttgcaagttcttcaatcggctggacgattgccgtaagggacggctccaccatctccgttatgaaagtgccgtcatatgccacgaacttcacatcctccgggaccctgcggtgtcttcttatggtttcattcatgcattcgatgaccggtctgtccacgccaaatacaccgtcaaattcgattccctttgcgaatacgtctttcacggctttcttgtaatattctgaatccagacggttcctgcccagttcataatcatacgtatatatcccattctccttcatgatacgggcaaattcaaaatgcctgtcatgatatggtgattccaccgttaccttgccgcggaaatgaagcaccttcctgcatccgttatcaatcagtgtcttcgctgcaagccttccgccctctttgtggttcactgcgataacagggatatcctcacccagatacctgtccaatgcaacaatcggtttatggattttcctgtactcttccactgccagtgaatgggctcctgtaatgacaccatccacgatatgccggttcagcatatccagatattccaactccgcattaaattccttttccgtggtgcagagcatcatcttaaagccggccttatatagttcagactccacatggtcaacgaattccgcaaagaacggattggatgcatttggcacaaggaccgctatgattcccgtcctcttatgatacagattccttgcaagctcgttcggcgtataatccaatgtcttcatggctgcttcgatcctgctgcgcgtctcatccgatacatatccgctgtcattcaacattctggataccgttccaagacctacattagccagcttggcaacatccctcatacttgccatatattcacctcctctgtctcttacttacattttaattgcttttgattaaaagtcaattaaatttagtctaaaaacagatgggcggccatagcctattcccgcttcggtaacccacctgttatttaacctatgtcttcctaattatccaatcattcactcaaagcctcaaaaaccaactgtccaaccacggctccaccatccaggtgccccaggctcttctctccataataggcagcccgtccatgaaccggcttcatctgttttgtggcctctgccccgtcagcagcagccctggccgcattctttaatgccatctccagagttcctccctctgcaattgttttctcacaagcatttacagcaggacaaagggaatccagtatggtcctctctcctggcttggaacctgctttttccataattttattaatcccggcctggaaggcatccactatctccgcgggacctgcctcgcactttcccttcaggcttcttgccatccccataaagccaaaggaaagtatggttcccaggctggagggtgctgcttcattaaaagcatttcctgacttcatgagaatttttcccaagtcctcttcctctgacagttccatcagcatatcgactgccttgaatccatcgctcatggatatacccaaatccccatctccattctgctggtccagctttacaagataatctttatttgcctcaatctttctgctgattttctttattgcatttcctaaaccctgtacgtccatactatcttacctcacttattataattggtataaaatggagacctggcaacctgtcctaaaagcccctttaattcctcatccagcttcatgatggtaagggacaatcctgccatttccatggaggttgcatactccccaatatgaggcatgtacacacttatcccctgttctttcagcatctgatgtatacggcggtaaacaatgaactgttcttccaaaggagttgcccccagtccgttaaccatgacagaaacttcatcaccggcttttaacggcatatcttctgtgattttgtccaaaagtatttcagccacctggtccgcgttcatcatcttacacacctccaggccaggctcgccatgaatccccataccaatctcaatctcatcatctgcaattgaaaaagtaggttcccccacctgtggaacgatgcatgaggataatgccacgcccatggtccttatattatcaagcgcatgctgtgctgcctgggctacttcctccagattcccgccgttatctgcctttgcgcctgctatcttaaaagcatataccattccggccacccccctgcggcggtcggcttctgccttgggcgcgctggcgacgtcatcctttaccaggaccattttcgtctgaatgtcgtcctccatatccacggtctcacaggcaagttcaaagttcatcctgtctccgccataattgccaaacagcaccaggaccccgcttcccttgtcgcaagcccgtatcatatcagccatttttgctgcggcaggggatgcaaacacattgccgaccgtacacccatccagaagtccctgccccacatagcccaaaaaaacaggcagatggccggaacctccggcagtgacaattcctacctttccttcccttgcaccgtaattgcttaacagaatacggtaatctccatccagcagctttactttatctccataagcggcaatgataccttccattgtctcttttacaaaatcttctggcttattaatcaattttttcattatgcccatacccctttcatagtgaatcccttattcatgctgcttcgcctgtttccccagataagcctctgctaccctgggattattgcgcatttctgaggatggaccgctcatcttaatcctcccctgttcaatcacataagtaaagtcagaaatcttcattgcaagtcttgcattttgttcatttaaaagaattgtcattcccgtcttattgatttccactatcttctcaaacatttcacctactaataacggagacaatcccatggatggctcatctaacaacaggattttcggtcttgccatcaacgcccttccaattgccagcatctgctgctcaccgccgctcatactccaggccagctgcctgcgccgttcctttaatcttgggaaaagttcatataccatctccaattctgcctcatatgacttttttccaaaatatccatgccacacaatggtccctgtctgaaggttctcctccaccgacaagcctggaaatacatggcgcccctccggtacctggatgatgcccatcctggctatctgacggctgtttttccttacaatctcggtctgaccatcaaccatgatagaacccttatgggtaatagcgcccgatatggaattcatcaatgtactctttccagcaccgttacttccgatgagacaggtaatcttacctttttcaatcaccatatcgattcccttgagagcttcaatgggaccgtaataggcatgtaaatctttaatcttaatcatcaaagtccctccccaggtatgcttccagaacaataggattcactgcaatctcgtgcggcagccctcttgcgaggatttcgccaaatacaagaacatctatattttcacagctgctcataaccagatccatctggtgttctatcagtaatattccgatattgcgcttcttggcagcaaacataagcaggttccttgcctgttctatctcctgagtggtcagtccggcagccggctcatccacaagcattactttgggatggcttaacatcgacctgacaatttccaggattttcctctgcccaaagggaatcgctgtaatatcttcatcccagtcaaacgtaaatcccgccatctccatcaattcatccaattctttcagaaagtcgcttccctttgtcccaacaaagcttttaagataccccagctggtcatgcagatccactcccaacatcagattatccctgatattcgagcggtacaaaaaccgtggtgtttggaaggtcctgccgattccctttcttgcgcggatatgggatggtatattggtaatgtcctccccatggaaaaaaatcttcccctcatccacctcatagataccgcttataaggttcatcatcgtacttttgcctgcgccgttggggccaatcagaccatggatttcacctggctgtacttccagattgacttttttcgccgtcacaacaccgccaaaacttttacagaccccttctaactttaatattgcctcgcccatactatcctcctctgatttcctatgattttagcttattcttccttctcatggtcttcaggaaatccgaaacggcgccgccaatacccatgggcatgaaaatcatcatgataattactgcgataccgtatataaacatcagatacttatcaagtcccctgagaacttccggtaaaaaggtaacaatcaacgctccaacgaaaatgcccggagtgctgttaattcctcccaacattgacatgatgacgatagtggtactcttggcaaaactgaactggtctcctgatatgaaacggttatgctgggccagaagggtgcctgaaagtcctgcaaaagcccctgctattacgaatgcaatgactcttgtacggtatatattcactcccagggtctgagctgctaattcattgtcccggatagaagcaagggacctgccaagacttgtcctgcggatccgttccaccagaagggccactatgatgactgctcccagaagaaggaaataccatttcttatagctgtcaaatacaaaaccgcctgctgacaatgtcctgatttcgggaattccttttggccctccaaatgccggctcataatttaaaaacagcgtatacagcacctgcacaaatcccagtgtggcaaaggtacagaatgagcttttcaacctaaggaaaagaattcctgtggcccaggcaatgagtgcggtgagcactaccgatacaataatggccgcatatccgggaagtatgaaattcatacgtccggaacaaagatttgctgtgatataggccccgattcccataaatgccacaccggaaaataccagctgcccgcacattcccagcataatggaaaggccataggccgtaatcatattaatcaacgccatattcaccacaagaaccgtataattgttcattttaagtgagactatcaatgaaaagataattaaaaaaataatcattgcccctgttttagggtcaaacttacatttattcatactatttcctccttaagccttatcagcgaccttatcaacaattaacccctgtggcctgaatatcaggaagataatcagaatcaggaatacaatcgcatccttataggaggaaaacttgaccgtagcaaaagattccacgatacctaccagcaggcatcctataatcgcacctttaatgcttccaaatccgcctatgaccgtcccggcaaatgcccttagctgaagggatgccaaggatgtggtaactgtatatacaggggctaccatatagccaccgatagaaaccagaaccgcaaccagcatataggtgacagccgttgtcattaaagttgatattcccattaattcagctgccggtttgtcctgtgcggctgcctgcatcataataccgatatacgatttttcaaacaggagataaatcaatgtcatgactgcaatagcaaccacaataatcagcaggaactgtgcctgaagccttgttccaaaaagattgacagtcagggcatttcccttggaattctttaatattggtgagattgttctgggccaggatccgaatatgatcatggttccctctgacaagaccagggatgctcccatagtggcaataataggcgctaccggataagatgcctttctgaggggccaatatgtcactaacatgaatatcaggcctaatattgcataaaacaccaatgataacggtgccgcaatataaaatgggagctgaaaatccataaaaagcacacatgcaatatatgcccctaccatcaataaatcgccctgtgcaaagttaaggaccccgactgcccggattaaaagaatcaatcccattgcaatcattgcataaatcatccccatcgaaagcccatttaccagcattgaaaaaaatatgctaaaattcacttttatacccccaattccattctatgcttacccgggaatgccgccagctggcagcattccacctaagcctgcctgttatctgaagttaacaatccttacaggaacagcttccccgcctgttgtctcacaaagcatgatatacgttgacattacatgatagctgtcctcatatatcctgtaatagttgtttgccccctgcaggtccgtacttcccatggcttcattgattttctcacggtcttctgtggttcctgcccgttcgcaggcttctttaaagagatagacacaatcatagccccaggctgactgcattgcacttttagcgtcgtacagtttctcataatcctcttcaaatgtcacagcacgctcaggcacatccaaatcctgtcccaggatattaggagaccagtccgccaccgtgtaccagccattcgctgcatcctttgccacttcgataaaaggagcgcttgcaaaactggaggaccccataagagggatatcacagcccgctgactgcagctgctgggccagggctacgtcccatgcctcactgacccccattaccaccaggccatccacgccactgcccagaatctggttgataatggagctgaaatttgattcattctccggtgcgccgtagatattgttttcggaaaccggatttcccttttcttccatcgccttgacaaaattatccttctgtatggtggtagaagaagctgtggtgtaaagaacagccgggttcttcatgttaagttcatttaaagcaacgtctgccatgattggaccggtaaagtcatctgtcaccctaatctgccacacatagggattctttgaagcagagatatccggattagagccattagcaaaatatggaaccctatttttctctatctcaggaagcaccgccatgcagttagtagaaaaataggaaccaatgatagccggtacgccgctttctatcagcttgattgtagcattaatggcaatggactggtctgtgccctcatcctgcacatccagaaccagttctttcccaaggatgcctccggctgcattgatttcattcacggcctgattcattccattcacatagtaacctccggtcagctggttaggcccggtcaggggggctgtcgcccctaataccaccgttccatcaaagcttgtgttgctgctttgtgctgtctcctcttccatttgctgtgccacagtacttcccccggacgtccctgcagtcccattgccggcacatccgctcatcatgccaaccgtcaatgccatgcttaaaaacagtgctgcttcttttctcataataacatcttctccttctatgcttttatttttatggtcttaacattactttgcaggcatccgggtcattgcaggccacatcaaatgccttggcagcatcagccaggtcaaatacatgtgaaatcaaaggatcaatctgtatcattccgtttgccacattctgcattgtcttttcaatccaccatggacggtcaatcttaatgcggtgcatcagtgccagtgtccggatatcaaaaccatcgttatgccatctgttgatatacagctgcgccggttccagcacccagctgtaaagccccataatacctccatgcttaagcacatcgctgcacagctggattgccgtatcatttcctgcaacttcaatcacaacatcagctccctggttatttgtctccttcagtacggttcctaccacatcatccttatttgggttgagtacaatgtcagcccccatcttcttagccaggttcagcttaccatccactacatccacgcaaatcacttttgcagcccccatcttcttaacaacctgggcaatgatctgtccggcaaatcccacacctaccacaactaccacatcgcctaattccacccctgactgcatgcctgcatagattgcacaggctgtaggttctcccagcgaagctgcttccatgctcatcccctccggaaccttcacaacaccatagccgttatgtaccactggcgcaacaaaataatccgccatggtatcataccatccaaaggacattaccttgtcccccaccttaaaatcagttacattctttcccacctcaacaatcacgcctgctgcctcatgtcccatttttaatggataggcatgatgggcctcattgttcccgtcaacctgttcaacctgtacttccctgggcattttaccttctgaataattcttgtctgtcccacatatggatgccaggtatgtcttaaccagcacctcattgtcacctggttttaaatcatgctcctccaccacaacctcatttggtttttttgtcactacaacccttgttctcattatttccctcctggtatttagttatttatataggctttcagcctttgaacctatatatagcaactttcatgccaaagagaaacaacgtttttttcaggcatttcgaaacctttttctcatttttctcaaattcttcgcacgaaaaattcgcattatgagaatttttttcataatgcgaattttatcactgcattttattgatacggcggtacagggttgccaaactgattcccatctgtcttgcaacctgttttttcccttccgtagtatctccatattgtttcagtaactccttcatatgaatcatttcccttaatttaaaatccatttcccgttcttcctgtgtgtttacctccgcatggaaaatcctgtcttccatgacctgggccggcaaagtggaaatacccatgatgcctgatatactgtctgaattcatggaaatcatatactgtactacattttcaagttcccgtatatttcctttccactgatagcggcaaagatgctccattgcttcctgatcaattccggaaacatttacctcaaagaaagagcggtatttttctataaaataatggaccagcagcggaatgtcctccgggcgttcccgcagcggcggaagatgaatctcaaaaatattcagtctgtaatataggtcttcccggaatttcccctcctccaccatcttttccagatttcggttagtagccgatatgatacggatattaaggctgacctgtttatttccgccaacccgctccagcttgcgttcctgcaggacacggagcagttttgcctgaaggtggaatggcatctccccaatctcatctaggaatatggttcctgtatcagccaattcaaattttcctatcttaccgcccttttttgctcccgtaaacgcaccttcctcataaccgaacagttccgattccagaagttccatggggattgccgcacaattgactgtaatgaacggattaccacaccggtccgatgcattatgtatggccctggcgaacatttcctttcccgttccagtctcaccggtcagcagaatatttggcattgtcctggctaccttttgggcgatttcttttaggtgtctcattctcggactgttgcctaatatatgactgaaggtaatctggttttccctgaacgcttcacctgcaatacggcttccaatattgacgatggttttaaaattcagtatttttactaaatcctcccgaccctctgccaccttataaaatagcgtcccgtaactttcttctcctatttttatcttctcatagacattcacactctcatcctcaatcattttatggaaaacaggatccggtatcaaatcaaggatatttttttccaggacggattcataatccattttaaaaatattcagggccttcctgttaatattacggatcatgttatctgcatccaacaggacatacccatctgaaatctgttccagtacctggtttaatacttggttctggctgtccagtttcctataaatctgctgttccttctgccgtacctcctcttccttcaattttaatgcaattagttcgcacatgctctggataaaattcaaaagtcccctgcgttcatcctttatcttctcaatatgctccttttcataacatataagccccatcaccccaatgactacgttgccatgcacaatcggacaatggagataccccatttccttacagctggcccgctgattgcaattcaggcatgcagggcttttcctgtccacggtagtactgattgcatactcccctgtttcaactacccgtttaacaatacctccatttttaggtatcggtttataaacggttcccgccaccctctgaagattactgtcaatcacctgtgtatcaatgccgattgcaaaggtaattccttgagctattttctgaataaaatccctgatatccattaattcaggcatttctccccctcaccttcatatgtttttcatgtttatgattacttctttatagttttatcatcaatagaataaattctcaatagtttttggtttataatctctgtattcttagccatatccattttattcatttgaccatattcttttaaaaattctgaaaaatataaaaatagcccggaagaatcatctcccggaactattttaccaaatccgcaaatatagatggttccccgaatccatcccgcatcatctgtccccggcaccgcagccattgatattccccttcccaggtccttatttgcattaatcctgtccaatacctgactgtagaacgacacatcagatatttttcatatatatccctaaagacactatgcgttttatcgtcctacatatcattttattatggagccattttatttccaatatgtatcatgtgtacataggcatatagtatgcggcctcaaaataaaatccgtctacaaatccacggcggacctggcaaaccgcacggtcctgcccttatgtttacgcctggtcaggatcaggcatgtggcggcgcacaggatacctgtctgtgtggcaaaggccgccccaaggctttctgtatatccgattgtcaggaaaccggcggcagccactgctgctgagaatagggcataaggcagctgggagaccacatggtcgatgtggacacactgggcgcctgtgctggacagtatggttgtatctgatatgggggaacagtggtccccgaagacagagcctgaaagcaccgccccaaggcagcagtacagcatcgcatcccccatccccagggcagaagccatctgcacgctgatgggaagcatgattccgaacacgccccaggaaaagccggttgccagcgccatgacagcggaaaagacaaagaggagacatggaaggagctggaaagatatattgtactggaccagaagcccggacaggaatgctcctggccggagcattccaatcatatcaatcagcacccatgcaaagagcagggcggtggtagctcccgccaccttttccataccgtaaaatgcagtggaaaacaattcatttccatggaaatgccaatatctgtatactgcccatccaagtccggcagcacagcccgcgcacagtgacagataggtggacgcatgctggagtatctcaaaaatatcccaggaaccagagaagatgcgccccgtcatatacatggtacccacactcactgccaccaggatgctgatgggcatgatcaggtcggaggcatgtttttcatgggtgtcgtccggcggtccgtcatcagccttgatggatgccgcatcattcatcctgcccaggttgatgttccatatggcgctgaggaacaccacggccagggaaaaaatcgcatagaaattataggggatggtctctatgaactggtttaacggagcagccgtccccggcagtatgatggcaaacagggcaatgatatatgccccccagctggacagcgggcagatggagcacaccggcgcgctggtggagtcaatgatataggccagtttttccctggaaaccttatagcggtccgtcaggcttctggaaacctcgcccacggtcaatgcgttaaaatagtcatctatgaatatgatgattcccagcacaactgccagaagctgggccatggccgcgttctttacccgtttctgtgcccatctggcaaaacctatggtcccgccgtttttgtcaatgaacgcagtcagcatcccaaggccaaggataaagagtaccagcagcatgttgtcaaaattccagtttccctccgtataaaagatccgtgccgccgaacccatgacagcctcaaccgcatcccccggacggaagccgcacaatatcagcgcgctggcaataataccagccgatatggaaatgaccacccttctggtagcaattaccagtaatatgacaatcaggggaggaattaaagaaatagcagttgtctccatgatgtaacccacctttcatccaatctatataatcacgctcatccaaccgtcacgcttaacggcagctttcctccaggatcattttccctccgtcaatcaccctgcagccctccagcacgctgtcctctgtttccagcaccagcggtttgatgaaaagcgctgtcttctcactgatgaactcggaagcgcttctgtaaaacaggctgggtgaatggtccaggcagtaatgcgcaatcccctcttccatatagatgggggaatccacggctgttggatgggaagtctcaatggcgccgtgctcatcacagctcacatcaatcagcagggcacctctttttaaatgtttcagatcctccctggatatgatatggtccctgcgccccgggtcccacagcacggcgttcactatgatatcaaactgtcccatctccttcttaaactgctgttcctgcctgcgtccatatacagtggtcagggctgcattggagacaagggccttataagcccccgcagccgtgttgccgcgtcccagcacggccgccatctttccctccatcagcatgccgtagcttaaacagccatggatgaccgatgcctggcccgcaaggatattattcctgtaaaaaatctgggtgttattctccagcatttcctcccaggcatataccttaagcttcctctccagcagaagtgccttcatttcaggatccacatggggatggacccagccgaaaaccgtggtgccttccctaagttcccccagatactccgcgtcccctgcttttgggtcacagataatatcacatctgtgcaggatttcttcccggggcgcaatggaagctcccatttccccgtattcctggtcggatatccccaatctgcttccatagccctgttcaaagaacagatatccggcagccactcccagttccttcatgtggcgcggcagaagcgctatcctgttttcattttccttatggctatttataaatcccatggtcttcataatcagaacccgcctttttttgttttagttataccatcttttgattcaatggcaagagcaattggcaaggattgattttatctttatatgaactgccaaatccttatggtttgtttatctgaggcaggtggaacggataaacatctgtctcccgaaaaaaacaccactaaaaaacgcctgagaacagtaagttcccaagcgcctatcatcatttttctggcatgcttttttatggacagattcaggaaaccgtcccgtccccgccctccgcaggctcttccgctgctgcgtgtaccgctgtaaccgttgcgatggtggcatccagatccgtgacaagatcgatattcctattcttcgcaatatccagatcccctacccggattgtatcgccggctttcatgtcccctacatcaaccttcaccttatcaatgagtgcatccggcagggctttgtaggatatttcctgaagctgctgctgcaggacaccgcctatcaccttatcatggtttaaaaggatgatttccgcaacggagtggactttctcaccgcttacaagcgcctggaaatcgatttcctccacaagtcctttcatcgagttaaaggaaatgtctttaatcagggcatcgtagacctgtccatccacgtctaactggatctggctgcctttgttacatgttttaaggagccgttccaccacggtcctttcagctttaatgggaatggattcctggatttccttgccgaaaatatttccggtaacgaatccctcccttctcaatcgtcttgctttgatggacatgcttcttttttcagcttttaaagtattcatttatcttttcctccaaaatcctgattgcttagcagccttcaaatttgatttgacaaataggtgtgttaagtaagtttactttgttacaactacattatagcactgttgtcaagcctttttgtggatagctttaagtacaaaaagccccgggaagtttctctcccagggccttgagtttcaaatttataatatcccaaaatgtgcaaatgcttccgtggccgacattccttcctcaatcgccttacggaccctcttttcaccagcagctttttccagtgctttttcaatcacttcctcatgtacctgcctggggattacaagaacgccatctatatccccaaatataatatccccgtccataaccgtcacctgtccgatttcaaccgggcatctgaactccaacacatatgtacggatactggagtcctgcgcccagcatccttgactaaagacaggaaaatcctgcgcaaggacctgtggtgtatccctatggcagccatccagtactgccccggacgctcccctcattttcgctgctgctgtcaaaagttctccccataaagcgctgttatgcgcgccggtggcaatatatatctcattcttttccagctggtccagggcttccgtcagcaggccaaatggttttttctgcgggctgaacacatcgcattccaaaaccgtacacgccttccccgccagtttcatatgctccttcagcggccgtatatactgcggcaggaactgatgtgtatatcccatcacgtccaggatgtcccccactaccggggtatacagtttttccttcatgaggctgaacatatcttcctcattattccagcttttcatctgatatcctccgttttaaaccatgtattcatacatcaaaatatgctttcgcattgtaaaagctgatatctgaaatcatttttttcagtatgtcctcatcctccggaaattctcccatttccacccaatttccaactaaattgcacaaaatacggcggaaatattcatgacgcggataggacaggaagcttctgctgtctgtcagcattccgataaacctgcccaacagcccttcgttggcaagattcttcatctgctcttccatcccgtcacgatgatcctgaaaccaccaggctgttcccatctgaatcttggatggaacactgctatcctggaaattaccggccatggttgccagaaccatattgtcccggttattgatggaaaacaggatggttttcggaagctgccgtgttttttccaattcatccatataggcggccaggggaaccgccaagggatgatccccgattgagtcaaatcccgtggcttcccctacacaggctaccatcctggtattgcgtgaacggaccggtcccatatgaagttccattgcccatttcctccggctgtattcccggcccagccagaccatcagtgctgacttataggcatccacttcctcctgccccaagtcttctccttcaattgccctcctaaaaatctcctctgccgcagcttcaggaaccggcgcccacataaaccgttcaaacccatggtctgccgccacacatccacttgcaccgaatgcatccatcctgatttctaacgcatttttcaaatcttgaaagctgcgtatctccacaccggacacgctgccaagctttctcatataatcacgccacggtttcttttctatctccagcgcactgtcaggcctcattgcaggaagtacttttacaggaaagccctcctctgccagcttcctatgatactccagcgaatcggccgggtcctctgtggtacacataccataaacattggatgacataatcaatcttctgggtgtaaaaccgcctgactgtatggccgcattggcctcctcccatatttcccggcaggttgacggtcctaataccttatcaatatgaaaataccgctgcaattccagatggctccaatgatacaggggattccccgctgcatatggcagcgtttctgcataggcctcaaacttctcataatcactggcgcttcctgtaatccgttcttcgctgattccattggctctcatggccctccacttataatggtcaccccccagccataactgggcaatattatccgcgggtctgttctcatagatttcccttgcgctcagatggcagtgatagtcgaatatgggcagggtttgcgcatatcggtgatacagtctcttagccgtatcattataaagcataaaatcttcatccatgaatctcctcataccactcctcctcattcatcagacgccatatacaagattgggcaggaacagcacaatctgcgggaagaataccaggacaatcatctcaagcatgattgccagaaagaagggcagggcttcttttgtatattcctctatgggacagtccagtatcccgcataccgtatataaggcggatcccacgggcggagtcatcacccccatggtaacgatggtggccatcagtactccaaagtgtaccggatcaactcccagttttgttaccattggaaggaaaataggcgtcaaaagcaggaaattcacgttactgtccaggaacatcccggcaacaaacaggaaaatcaggattacgataacaagaatctgtggattctctgtaattccaaaaataactgacgccagcttctgcggcaggtttacatacgtaaccgcatagctgaaaggacctgacagtgtgataatcagcattaccgccgcagtatccataagggaggtcctcagcgcccctataaatcccttaaccgtaaactcgtgatatacaaatgccccaaccaggattgcatagataacagcaaatgctcctgcctcagaaggcgtacagaccccaaagcggattcctacaatcaggatgacaggaaacatcagcgcccagatggattcccgcagtccatgccatacctccccccatgtaatcctcggtatctctggacctggcttctcaaatccctttttggtggatgtaatcttcactgtcagcattaatacaaacatcatgatgacgcctggtactattcctgcacaaaacagccgtccgattgaaacctcgccgataaaaccatatagaatcaatccaaggctgggaggtatggtcgctgttatcaggccagtcagacagttaactgctgtaatatatcctttactatatccgcgtttcatcatttccgggcccagaatccttgtctccatcgcggcatctgccgtggcggaccccgagacccctcccatcattgtgctcatgacaaccgacacctgtgccataccgccatacatgcgccgtgtaagaagggaagcaaacttaaggatacgcttggtgattcctgactcgttcatcaaattcccggcaaaaataaaaaacgggactgccaggaaggaataggactgggtctgggctacaattctctgaaccgttatggaaaatggaatgtccggtgtcacggcaaaaaatgccagtcccgatattcctattacaaaagcaacgggcattcctattacaagcagaaacaaaaatgatactaatagcactgacattatgcatttcccccttccatgcctgctgctcccctgccggtcaggcgcttcacggtttccctgattttaaggatggctgtcactgtcatgaatacagaagaaaccggaaggctcagtgtaacataggaataactgattggaagcgtctgaaatgcgcgcttccagctatctgcactaagtctgaacccaaaaataataaaaatgataaatgcaatcaggataaggacctgaatcacaagcgtcaggccatcctgaaccctatggggcatctttcttgtgagcaggtccaggcccaccagttttccccgcctgaacgccacatcggctcccaggaatgcggtccaggccaaaagcagctgcgacacatcaatgctccaggccaacggatgctggatcagcctggcaatggctgacagaaataccagcagcaccatgctaaagaaaaatacacagcttatgatttcctccagtttacaaaaaccccggtataattttttcatctgtatccctccataattaagcagaaacaaaaggcggagcctgaaaaatccatgctttccacattttccagggctccgcccgccggtatgttaccggccttaccggttcctacttcatctcagccatcagctgctcccttacttccttatatccaagcttatcatatacaggggcggttgccgccttaaatgcctcgacatccacatcatcattaatggtaacgccatatttttcaaccatttccttctcatactgctctgataggtcggcgcattttgtctgatattcagtacccacctccttaaaggtatcggtaaacagttccctatattcatctgacagggaatccctgaactttgtcccggtgacagcagaaccaatgagctggaaatgctctgttttattaatatagctgcatacttcccacaggcgtgtggcatagaaggatggggtctgaacctccgcaccatccaatgccttctgctgaatggaagtgtacacttcgctccagctcataggcgttgcaactgctcccatggcatccacggaagacgtacacaattcatttccaatggtccggatacgctgccctgacagatcctccggttttttcacttctttgttcaggcagaagtttctggtacctgaaaaccagttggacgtaaccagccagattccctgatctgagaattcctgttcccacttagcatataaatccgtttccatgattttatccagctgggtataatcatctaaaagatacggcatctgaagcataccgtaatcttttacaaaggatgcgagacggctgggatcggatatggtaaggatagcagctccctgcatcgcctgttctgttaaatcatccgtatcccctaaggctgaacttccgtaaacttcagccgtgaacccacctcctgaagcctttgacaaccggtctgctacctcatgaagcgatttggtctggatatcctcttccccctgggtattcccaaacttaatggatactttttcaaccgcttcaggcgcttctgtttttgtatcgtctccttttttgtcacctgcatctgccgcctctgtcctggcctcccctgctgcaggcgcgcctgttccctttgaaccgcatccggataacatggatactgtcattgccgccataagaaccatcaccattctctttttcactttttttcctccttgtttgttatgataaatttgcatcgttttctaaataaaatcagaaaccgattgaacatcccccgtcaaccatcagcgctgttcctgtcacaaatctggaagccgctcctgaaagatatactgccgcccatccaacatcctttggcaatccatagcattccatgggcgtatggcccagaatctttttctggcgctccgggtctttgtctgttgcctgatggaacataggcgtatcaataaagcccggtacaattgcattgacccttatgccgtcttttgcaacttctcctgatatggtttttaccagccccaggacagctgccttcgctgcggaataggcagttacattcgtcattcccataaccgcggacatggacgagatgaaaatgacactcccctgcttattcgccctcatatatggaatcgccgcctgggtaagggcgtaagcgccgaagagatggacatccagtacggactgcagatcctctcttgtcacatcctccacagcctttttgcaatgtacccccgcattgttaatcaggatatccagccttccataacggtttacgatttcctttatgatttcccctgccctgccagtatccgtcacatcatattcaatgccggcaacgctgtcacccagatgggcacaggcttcatttaatacctgcctgcgccgtcctgctatcaccacctgggcgcccgctgccgcaagacactctgccatggccagtcccagaccgcttccccctcccgtgataagtgcaacatggcctttcagtccaaatgcttccatcattccgtcattcatgtctcccctcaccttcttccagtatatgcatcatcagtccccgttccatcatctgcatggcagacctcatatatcccagtgcaaatgccattcccgcatgccatggcgcaccgcataatatttccggcgtatggtccggcacgattacgccatcgaatccgcactgttccaacagggccagtgctttaagcatatcaatgtccccgtcgtcgacaaatacttcattgtatttagggactttcccttttacattcctaaaatgtatatagctgatacgcttttgcccgccatattgccttatggcatcgtagatatttccatgggtcatctcctggatactgcccatacagaattccaatttgttggatgggctgctgctgatatcaattaccttctgatatagctcaggctgatataccagccggggcgtctgtctcaacccttcaaatggcggatcatccggatgcagggccatctccacccctgcctcttcagctacgggaagtatctccctaaggaaacgttccagcctgtcccaaagttcttcggaagaaaccggggcaatagcgctgccgtcggatttggcataggtcatattccagatttctccttttggaattggtgaatccaccttaatcctggatgcgtcgaaacatgtcccatacgccccgccgcggcatgagcgttctttctggtgcccccatacgcctgccagactgaaattatatccaaaggaatgaattcctgccttccccgcattgcatatgatttccttaagatgttccatctgacgcgccctttccgggccatccagcaggacatcataccagtccgccggactgaaattctcaatcccataaatagtcaggccgtgctgccccgctttttcctgaagggcaatcatcgagtcttcctcccaaatcccttccagggcctttgcctccccgtaattcactttatcatttgttgccgtgacaatctgatttgaatagtaatcagccagatggacaatcagatgggtacagccacattgcctggcaaaggcaaagtattcatctgtcagcatatggcggtataatcccaatcccagtttaatctcagccatatatccgtcccctttctccgttatgtcccaagtataccgcaaagcctttaaaaatacctcttgcattttatcaaatttgtgctatatattgatatataacaaaaaacaggagtatattttatgttgaatattatcaatgatataaatctcatagacccccgcaccgagtcacactaccgcttccatacacagcttgacccttcccaatatcctcaggtccatgatttctatgagattgtccttgtaacttacagaaacctgaacctgcagatatgcgggaaccgtttcaccctgcagcccggagggatggcgttaatccgtcccggtgatatccattccaagtcagggaaggacaatgcccatatcaatctggcgtttccctccgcaacgattgacgcactgtttgactacctatgcaatgaaaaagaacgggatggtttaaaacagctgccctacgttcctcctgtccagctaagccgaccggagcttttaaatatccaggaaaagatgcagctgcttaacaccatcccccccaatgaatgtgaaaaaatcaggactaccctgcgcagcatactctttgatgtggttacccactatttcctgccctctttacattccaatcatatccaccagtccatcccccaatggctggcttccgcccttaccctgtggcagaccggtgaacaccgcagcgaggggctggatttcttctgtgaacacaccggatatagtaaggaacatatctgccgtacctttaaacgctgttttgacatggcgccaacggtttacctgaacaggcagaggctcaattacgccatcaacctgcttctgcactcagactattccgtgacagatattgcatacgaatctggtttttgcagtcccagccgtttttaccacaccttccgtaatacttatggaatctcgccaaaacagttttgttcacagtatcatccctccatattacctgagcagccgttaacacaatctgataatgagcaaaggagtactgcagataatgcttgaagttcaatccctcacaaaatattatgggaaatccatggcaattgaggatatcagcttttccgtgggccgcggagaaatagtaggtctcttaggccataacggttccggaaaatccacaaccatgggcatcatgaccgggtgcctggccgcatcctcgggacaggtcctgatagatggggccgatattgcaacagatccggaacaagccaaaggaaagcttggatatcttcctgagattcctcctgtttatcctgacatgacggtagaagaacagttgacattcgcgtcacggctccgggctatccctgctgctgactgtcctgatgcagtggatgatgcatgcaggaaactgaatataacgggtgtcagacaccgtctgattgaaaacctttcaaagggctatcgccagagggtggggtttgcccaggccattctcggcaatcctcccctcatcattctggacgagccgacggtcgggatggatcccggacagatcatcgagctgcgcaatgtcatatcagaactgggaaaagagcgtaccatcatactcagttcccatatcctttccgagattacggctgtctgcagccgtatcatcatactaagcaacggccatctggttgctgatgatacaccggaaaggctgcttcatgccggagattccgccagccgtatttacctgtgtacttctgcgctcccgaagatactccttccccgtctggcccatgaatgcggcctatggaatgtggaaagctgcgggtctgtcctggaaggaagatgggattatatcctctcccctgatgatgaaagccttttctatcagaaacttcctttgctgatccaggaagccggggcatccatctatgtactgaaaccattagagcaagggctggaacaggtatttctgcagcttacccaggacagacgtcataaggaggcttcccatgaaagcaatttatcgtaaagagctgggcggatatttccataccatgtccggttatgtttatctgtccatattcctgatgatcagcggatattactttgtgactggaaacctgctgtcaggtaacggggatatgaaaaattatttttcatccatggtccaagtgggcatgttccttcttcccatgctgaccatgcgttcttttgcagaggaacagaaaacaggaaccaaccagcttttaatgtcctctcccgtatccggccctggaattgtaacagggaaattcctggctgtcctcacggtctttgccatcggacagtctgtcagcctgatatatggcgcaattcttgccgcctatggacaatttgacccttatctcctgtcaggcagcctggccggaactattttggccgcatcggccttcatatccattggtctgttcataagttccgtcactgacagccaggtggtggccggggtcatcagctacagcatccttatggggttatggctcatcggatatataggaaccttcctgtcctcatcccccctcaaggcgctggcttcctatctgtccttatcatcgaaattcatggaattttccatgggactcctgtccttgacctctgtcacctattacatcagcattgctttcctgtttctcttttttaccatattgatgcaggaacggcgccgcatctgctaggaggggaatgaaatgaaaccattcacatcggccttttatatcaaaagtgcagcattactggcagccgcagttatgatactgtctaacatagccgctgaccatgctgaaaaacaattcggactcaggcttgatatgacagccagccatttctaccatctgaccgataccacgaaggacacagtttcatccctgacatcacccgttaccataaccgtattaaattccagggaagcctttctgccaattatgcgcgaaatcctggaccggtatgataccgccggttccaatctggaggtaggatatatagacccttatataaaccctgccattgcagaggatttaaaaaacaaaggatatagtgccgccatggacaatatggttgtctccggtccctctgcaacaaaggtccttgcgcttgaggatatgtttacgaccggcccttccggggcagttaccggcatagccgccgaacagatgctgaccagtgccatactctatgtttcacgggagcaggttggaattgtcagtttttctgacggacatggcgaaaaaccctccgacaccctcatcaacctttttgaacagaataactaccatattgaccatacaacgctatcccttcaggatattcaggaggatacctccctgtttattctcgccgcaccgtccagggacttttccgatatggagattgggaaattagaacagtaccttacatgcggaggccggatactggccttccttccaccagataccgccgaacttcttcccacactctccggttatctggaagaatgggggattgggacaaccaatgggataatagaggataccaggcttaatgcggatgcaaatgcaacccatatcgtacctgtctatgcttcccatcccataaaccagacattagggaactcccgtatctaccctatcctccctgtctgtacgccattaaaccagcttttcatccggcaaggtaccgtgactacatccaaaatactttattcttcacccaatgcaacggttaaaaatacccaaaagagcggcagaaatggcccttttaccctcgcgctctctgctgaaaagcaattgtcagccggtaataccgcccggatgatagtcatcggcagccaaggaatttataacgatttccagatggattcacccagcactgctaaccgtgactttcttttacaggccgtaaactggtgtactgaaactgattttcaactgaacataccggtaaaatccctggaccagaagcccataaccgtattatcctatcagggggctgttatggctgctgtattcatcatggtccttccagccagtgttttcataaccggtatatgcatccgcaggcggaggaaacatctatgagtacaatcaaaaaatggaatcatgtattgtccggcctgtccataggccttgtcttcctgctgctgtttctcttgttccattccagccagggccacctggacagccctgaactaccgcctataacagatttccctgtaagcagcatcaatgctattgccatcaaccactccactgattcaatcggattgattctacatccgaccggaattgaactccttaatcaggcgtcagatggttactcccagcaaaagctttctgcccttgtatacaaaatatgccatctgtccgcattgcggatcattcacccctcacaggatacagattactctttatcccaatatggacttgataccccctcttcatccatcagtctgattcccgcccagggggaaaccatgcggttctatcttggtaataagaatccaatcgatggctcctgttatgcaaagacggaacatgatgacaccgtttatcttatcagcccggacgatacctccatgttaacccagtccctttcccagctcaggattttagatttatatcccccgcttgcagcggaccagcttgaaaagcttgaaaagctgcaggtaacctgtgacgggcgcacgtggtccatcctccggggcgccgatgattccggaagcctctatcacctgtcagaaccggtacagcttcctctggactggcagactgcttataaaaaaataatggaaccatttctaaaactggttccagatactttcctgtctgattttgcatcaccaagtgaatatggtttggaccatccatccataaccctgacggccgtaattgacggaaacgaatacgtctcttacttttcacctgctgacggcgaccgttggtactgtatgtccaggcaaacttcacaaatctgcagcattcccgcagggcttgtaagcttcatgacacaggactatatggaattcttaagtaattccgtgtattccagaaatctggctgatatttcctccttaaccctctcaaagaatggggaatcgcaggaaatccaaatctcaggcgacggcatttatctggaaggcagggcagggaaccaggtttatgattaccagatgctggcggatttccataaacacatcactgccatccccgctgccggcctgatggaatcctctgatatagtaaacaccgcccccttcatggcactgacgtttaccctccgcaatgggcagactgatattctagagttccttccggtctcagaccgtctgtgtgccatatcggtaaacgggaacattgattttcttacctatacttccgtactgcgggatatcgtaacctattttgaggcctttactggaaaatcatttgatgattaacgccctcatactctctgatctgtctgacgcggaacactctgttttcaaaatgatgctgggcggggatattaaacttaagtcaaccccaaaaacaatctataaccaaaagtcggcccttcttaaaaagattcatttgaaaaaccagtcagaattgattcatatatttggcggtatgcggtttgactaatgcacatgccaagatatcataaaactggggcgggattttgacaaatcccaccccaatgattgacaaagggccggaaaaacagttaattcaactttttttcacagcctcatccatcccaactgccgttgaatcggattggctgccccttgtttcgcttgcctgtaatggaaagctgtgttgtaaaataacatccgctgtattttttggctgatttccataaaaccgttccttaacacgtcttgaaatcaattctacccctgcagcatccgcatcggacactaataccagatattgacaactgctgtactgcacaaatacatcatttctccgcaaactatcatgaatctgggtcttcagcaagagcatctcctgctcccggtactctggtttcaggattcccccttccttttctgtcagtgtaaataagataacataaaaggatttcaaatcatccttatgaccctgacggcataaggcacgttccaggaagcggtatatgccttgaaacacctcatagctcagataataagccccttccacaggagtactttcctgtaaatcataccgaatgagtttcgtatccatttcaactcttttgttcaaccgatcagccatttgagatttcggtgcacggatatggtgaagtgcctgtttattttgcagcaataacttgtcagcccggctaaacatctttatgtaatcatcccgctccatataaacagcgtcaccgaaggacgctgacaatgtaaagtattttgagttttttatctttatctgtcccaaccgcttttgtaacatctgtcttttctgttcaagttcttccatatccagggtattgggataaaatatgacaaactcatccccaccggtgcgggccaccatattattccccattgtttttttcaggatataagctacattctgcaacagttcatcacctgcaatatgcccatactggtcattgacatctttaaaattattcaaatcaaagagcagcatggcaccgctatgttttgcggccaatgcctcattgattttccgttcaatcgttatgcggttatatattcctgtcagtccgtctaattctgtcaatgcctttaatcgttgattttcctgctgtaactgttcctttgataatgatgtcttaatgttaagatctgtcccttcccataatgactgtttcattcacgctcacgctccattctcactgtgccggaacaaaaaacattatctttattttaccactgctttttcaaatcgtcaatgttatatgtaaacggtaattattttttgtaaacggaattttattactttcattcaattgcaatctaagcaacattggattataataaaaatacgaaatcacagcacaggaggaaacggagtgaaataccatcgctatactgaacaggaggttattgataggacgaaagaggccattcactatttcatcagtaaacagattgacccgtttttagaaatgctggacggggactttgtctgggtgggcgattatgaaccgctttacatgaaagggattaccgcttttctggaaagtgtaaaggaagaaatacaagtacagctccccataagtattacagaagaagagtatgcattattatcccatgaacgccgtctatggataacatatgggcgcttcacggcaaccatcaataggcaggtttcgagaatccactttacgcttgtctggcgccaaaagaatgaccatctcctgttgctccatgccaatgcaaaccacgcaaaacccatgccacagtcagacgcacagtccaggatatttgaattgccatcctgttcccgtcccccgatacacactacggaggcaaaaaaacaggctttccgcagtttaaccggaagcatccactacctgctgccagaggagatacgatatattaaagctgataacaatgtatgtcagatttttaccacctcaggtttcttttcctgccgtaccactttgaagaagatgacggcccctccctttctacggatacacaaaagctatcttgtaaattcttcccatcttcgggaaatctgccgctaccaggccacgctcttagacggaacaaaacttcctattgggaaggagtggtatatggatcttaaacaatggatgatgaagaattgtaatgactgacatgaagataccgtaacgccagccgtcagcaaaaggcttcctaatacggatctcctttgatatgaattagatatgtatagaccggattgtgggcactgcccacatcatcctgattttgttgcacaaatcgcaatggattggtatggtataagcggatatactgattggattgttaaacagcaagtggcatccaaactaccacaccttaatgcggcgctgcggcggaatagatgctaatccagaaatactgagcctactgctgcatttataccagccccaccttatccaagacttcctgcccgtttacatcaccgcgcacactcccatgactccttcagctttatacaacatattggtaacatatcctttggcacttccgaaagaccatgtcatacacggcgagggccaccatccttttacgcagcagttcagccaatctcttctgtacttccctgaatcgcaggtatggaaccatacaaaaaggattgccagaaaatagacggataacgatgaccctctttttcttatctggtatttcagcaaaaattcaattcactccccatcatcacatccgataaaatataagaaccagcaaattgccaacaggtcggccgcccctcccggggacaggtttttacttataaactgatgatccaaatcttttatgattgccgcagccggatatttctcctgattgagaatttcattcagctgctttttcacatctatatacgtggaataatccgatcttgcaatgatattcgtatcaaccgcttccgacaataagtagagaagcgtaatgcttcccgcttcatcctttgtacagccttctgccaacgcctttttcaatattggaagaccggcatggagaacggcgggaaatccatccgccgcttctcctctgacgccctttattccatatttcttataaagctgacatcccgcagtgggacgctgctgctctatatggtcaaaaacaaactccgcatatggtttcgacagggcgccgcattcccccaaaatctgttctgctgtaagttttcccttgttcccttttattcttccaatggcgccgcaaatgatgcccattgagaaaatagctcctttatgggtattcacattttgggttgcatcgaacattgcacattcagcattcactccttcatactgcaatttccgaaatgttttctctggtggttccatggcggtttcaatgccggttcggaccattgatttgaaatgtggaataagagctgccgcactatccacaaaagaataaaaatccatgtcacgatgcgatccattattaaaacgatccaccaatcccggttttggtgatacagaaacttcgtaaagcagcgccttcattgcgaaacccgctatcttatctacaaaatgattcaaaaagtattcttccatcatctgaaccgttttcttctgaagttcctctaacggatggaccctgcgggaagaacaccgatgaacagggccgccgcagatcagacatctgcgttcacccagccccacttctccccgttccatctttgttccgtcacaagccaaaacatcaatatcaaaaagtcttcccaggggatgcgtgtcttctatttccgacatgatacattttatttctattatatcgcaatccacaacaataaacgcttcatttcccgtggccttatgtgtcttttcataaaaaagaaccgcgattcctctgactcttaactgattaaaaatacattctgctccctcttcaaaggtttgctgaatcaaatcagaatttttcaccggccccgcaatattcagcgtaaaacagattaagtttttttcatatttccgtattaattcctgctggcggaatgctcttgcttccctcgccgccatcatgtctgtaacctgtacttttctgatttccatcttcacacctctttttaatcagtagtgtatgacgtcccgcgccttttgtattgcttccaacaccggacgcgcctcctctgagcaaagatattcccatgttggtttcggaacaaatggacaaacgcgttccagctgtccatcgtgaatccactgcctcaccctgctggcgctgattacttcctcatttatctttttccgcgggatttcttctgctttaatgcccgccttattcagctgttccagcatgacacgattgtacatggccgttaccgtacttttcttttcttctcccacaaatcgattggtaacgccaagttctccggcaattctttcaaatattgcaatgtccagttttgcgtgagcctcacatacaaccgcctcttctttaagaaaatagctgggaaatgttccctgtgaaatcatatacggtccgcttgcatgacaaatcacatttttcagatgcgcagttcccttttttaccaggtcctgccggacagaaaacggaaacatgctgcagtcttcacttaccacaaaaacatgaaggatatcacacttttttgccgcctcctcaacaagaaacaggtgccccattgtaaatggattggcgttcatgacgaccgctccggcctgcgttcccaaagccccgacatcatgactctcccgcttcaaactgtctaaatacttggaaaatccatttttcctgttctccaggaaggtgaccatcccatccacatttgcaatttcataaaaccccagattctgaaagaaacgggcctcccttattttcgtataaataaacagatgggtatatcccctggatatctggtactcggtcagatgccggatcaacaggttcaaaagccctctcccctgatagcggtgatccaccgccatacagcggagcgtatttccaaaacagcttcccgtggccaccggatttcccaaatcatctaagatgacacacgtataatccagattgccgtccctttggattccttcctgttccaggagccgggccactgcaagattcattttactgtctttttcagaaataccctccaccatataatccatttctatttcacctctcgcacaacatccataatggttccgtcgcggccctcaataatacctacgattcgttcaccaaatttaaccggctggggagtgcctacgatatcatacgcgatatcccttaattcttcaattgtccttaaaggaacacaatcggccttctttaacgcctccaacaggtcctgtctggccggattgaccgccaccccataatcggttactaccacatcaatgctttctcccggggttgtcactgttgtcacatccgtacagattgcaggaatccttccctgaagaagcgggcatatgacaatcgtgcattttgcgccctgggcggcatcaggatgtcccccctgggcgcctgtaatgatcccatctgaaccaactaccacattacagttgaaatgtgtgtcaacttccaatgccgccaataccacatagtccagtttgttaacgaaagagcctttgttaaacggattggcgtaagcgcccgcgctgattctgtgatgattcggatgctttacagaattaacggcaaacaagtcaaagtcctgggtatcaagtaattttcctacaagacctttatccagcatatcaaccattcctttgctcataccgcccacagcaaatcccatcttaatcccgcgttcctccataattttggcaagcaatgcggcagaagcaatggacgctcctccaactccggtctgataagaaaatccttctttaaaatatggcgtattaattaccacctgggtgcagtaatctgccatcatgatttttctggtgtccgttgttggctttgccgcccctgtggcaatcttttccggaatgcctatggcatccaccacgcacacataatccactcttgtcatggcaacatccgccggaaaattggggaagggaacaagacagtccgtaaccgcaaccactttattggcatgctgtccgtcaacaaaggaatatgataacacgccgcagtcgctctttcctccaatgcctttgcagttaccataatcatcacatgtgggcgccccgataaatgatatgtctatgattgtctccccactctggattgcccgcacacggcctccgtgggaacgcatgattgcaggcttcttcagctttccatgtgagatggcctctccgattttacctctgactcctgatgattcgattccggtaattgtcccatcctcgatatattccagtaacggatcatgtgcttttccaagagaacttgcacaaattgtcacatccctgattcccatatcatggacttccttcatgaccatgttgactatgagatccccttcccggaaatgatgatgaaatccaagtgtcataccatcatgagcgccgcatttttcaagggcttcccgaatggaagaaaccattttacttgtattgtggtccatgacaggttttacaatgggtccctgttttctgtactcaacaccttctttatagttgttgccctgaaacggttcctttcccgtcaatttgagaatttcatccggaatttcacgtcctactgcatttaacatctcaaaattcctccttcaaaactcctgacgcttttgccagttcaatggtccgctttgctccgtcataaaaggcaatatctatcatttttccatccactgtaaaaacaccgattcccagcttctttttttcttctatttcttttactaccttctgtgaaaaaacaatctccttttgtgtcggtgtatatatttcatgaaccggggcaatctgccgcgggttaatgacggattttccgtcaaatcccatcaaatggattgtttctacatcctttttgaaaccttccatatcgtccagatccgtatacacagtgtcaaaacattgtacgcccgcggcccgggcagctataatcatgtgctgccttgctcccataagttccaccccggtaccagtaattcttgtctgaagatcttttgtgtaatctcctccggaaagagcgattccaaacaggcgttccgaagcattgcagatatccagcgcgtttaacacaccctttgcggattctaaagccgccataactaaaacctttccaggctcgaccccaaattcgttttccgcctcttccaccgccttttctacctgtttcacatccttagcagtctctgttttcggaatgcggataccgtccgctcccccggctaccgcacaccggatatcctctttccagagacctgaatcaagaccattgattcttacgatacactcaatgcccctgtaattaatttcccgcagggcatgatacaaagaaaaacgggccgcgtctttttctttttccgccacagcatcctcaaggtcaagcatgatactgtccggtttataaatatatggatccttaatcagccctggtttctgcgcgtttaaaaacatcattgttcttctgagtctttttttatttggattcattaccgaaccgcacctccccatggcacatttgttgtctgtccggcgcttctgtacacagcgcactccacacgtgccttaattgtacaatctaacgctcctttgtccacaatcctgataaatacatctttcacatccaggcgctccaatgtctccctgattacttcctgtatctgctctccgaactgattcataaccacactttcaagctccagttccacactgccgctgcccggttcaaccgtcaccatacaatcgctggactcaagcgttccggcaattgccgctttgtcaatcttcatcttttcaccttccttgaaactttaataaaacaacccgccaagattaaacacaccaagcgcagaaagaattacatttaaaaatacatttcccaccgagagaaggaacagcgtccggaacatcttgttcagttcagccgtactggtttctcttgccgcggaataagacgacataataattgcgcctccggtagataaggggctgatggccgctgcaaatgatgtagctgtgattgctgaaatcagttccacgtaattgacgccgcttccaaacttttcgcacacctctgccgcaatcggatataaagtcggcataacaacccccgttgtagagctgacccaggacaggattcccgaggtggccgccagtatgggaaccgctgtcttttcaatcataaatcctgtcaggaaatcggaaaccagggtaataccgcccagtgtatcaatcacatgaatcaggacgccaactccacatataaacacaagcgtcccccacggaatcccttttattgctttcttttcatcaacaacgccaagaagaactaaaacagcagccgtggcaaatgcaaacaggcctgtgtcaagcttaaatccgatacagcatacaaccattacaacgattgccacaatcgtaagcagctggtcacgattaaactttggaatgtctgaaagcttcagcggattgtccgcttttactttatagcctttatacagtatgtatacaacaagtgtaaacaagaaccccgaaagcagtgttgacaaaaacagatgaaggccaaatccactgtaacccagaggctccgaaagatttttagctaaaacacccgtcaaagagagaaccgatgcgcatccggcattcgcccccagttttgcataaagagacgttgccataggattgatatccatttcaaaggccagatacatggcaaatgttgtcatcaaaatgcccgccgcaatatgccccggaccgattgctgaaatgaatgccgacaaaaaaaacatcagaatgggaatcaggattgtccgttttcctacaagcgcaaccaccttcttagaaaacagatccaatgttccattattggatgccatgccaaacaggaacgtaacacccaccagagtcacaaacatggaactgctgaatcctgacacaatctcttttgccgacatgcccccaaatgttcccagcgcaaatgcaacaccgatagaaaggaaccccagatttacttttcttataaaacctattgccactaccactacaagcacaataagcgaaataattgacagactcataatatatttcctccacacattttaaatagcgattcttgttccggctaaaaccgtactcttgctaccccttccataatcagattcgcagtgcgaaatccaaacgtatcttcgatttcgggaatcttattatgctgctgaaagtcaaccccgcattctaatataccaccgggatgcccaattcgtatatactgcgtatccatatgttttgaacacacctgattcactatgctgccgggaaccacagccgctgccgcggtacacatggcgcccgtcatggcgtagctgggatgtgctttctgcatggacatcattctggaaaccagatcaatactctcctgcgccacagtctctccgcccatggtcttatactctttgggctgcgccacaaatgttattttagggattccaggagtctcccaggcggatttccggtaatcgtcaatcaatcccagcttctctgccgcaagtccccgaattttttccaataaagcaagtacttcctcatctgcattcacatcatccggaagttcctttcccgtcagccctatgtcctgcgccttcacaaacacaagagggtttgccgcgtcaatgatggaaacttctatatttcccagtcccggaacttccagtacatcaactgcgtttcctgtgggcagcagtccctttcccaatgttcccgccggatttacaaatttaagttttaccggcgcggccttacccggcactcccgctatactgaaatcaccgtcatataccacatttccatctgatgtcctgatgtcggcaacaatcagcttatccgtattcgtattatatattctgactgatgttttatcattctgcgctttaatcaagcctttttcaatggcaaacggcccaacacccgatgaaatattaccgcagtttcctttgtagcttacgattggtttatccacggatacctgtgcaaatgtataatctacatctgcgtcaggtctgtgggaaggacttacaatggccaccttactcgttacggactgtccgccgcccagtccgtctatctggttcttatccggacttcccatcattctaagcagcacgtcatcccatttttcgcggtcatccggaagatcgctctctaaaatataaacccctttgcttgttccgccccgcataatagtgacaggaatatggaataaccctgtttctttatttaacattagatttcctcctgctgcaactgaacagaattatgtttacggttgtaattaatcagagaaccacagcggattatttctttttcttcctctgtcagcggctcaattgccagtgataattttcttattttatcaccaataataaatgccgtaatttccttcatgtcggtgttaagcgcctttttaatatcaggtacaaatatataatcatcctctgaaaaaccggcaggatcatttaaaataaagggtaccattccccagttaatcaagttcgagcggtatcgctttgtggcgtattccaccgagatattcgctccgccaagaagcactctctggcaggacgccgcctgttcacgtgccgaaccgtctcccggctttaccgcgtagattgtacttgaaagatcaattgactcatcctctactttttcatatcccggtatggtatgtattttatcaagaatttcccttatttcttcaggacagtttcctccttttcttgccttttcgttattcataaccgcttttgctttccctacgtactccggcgcccgtctgcttaatgtaaactctgccagccccataggattggatcgaaaggaaccggtttctccggacgggataagttcatccgttgttgttacaggatccgtgatatacgcgcatacctttagaagcatattctcattcaactccggaagctggggccaggccttaatattgggaccacagatcagttcctcttccggattgccctttccaaatccctgatacactctgttagcatatactttggaatcataatggtactcaggacactcatacacatatcccaattcatccgccgctgtgattcttccccggttggcggaagtcgccgcaacagaacgcgcatccatcaaggccacacttgcaatctgtccattacccggcttagatccctcacggttggggaagtttcttgtggtatgtctaactgcaaactgtccgtgggccggtgtatctcccgcgccaaaacacggcccgcaaaatgcagtacgaatggtcgctccggcagtggttaatgtttcaattgctcccttccttaagagatccatcataactgcctgagagcttggatagacacttaaattaaacgcgtcatttcctgtggatttattttccagcagataagcagcctccataatgtttgaatacgttcctccggaacagcctgcaattgttccctgatccgcatacaaggctccatcatggattttccctctaaggttcaactgcagctccggatttttaattaattttttcgcattttcttccacttcgtggagaatgtcatccagattttcatttaacacacgaatttcatatccgtttgaaggatggaacggcaatgcaatcatgctgtgtatggcagacaggtcgatgtaaatgcacccttcatagtatgcgatcttttgaggctcaagttttttatattcgccgcctcttccatgagcagccaaatactttttcgtatcttcatcggttctccagattgaggaaagacaggtggtttccgtagtcattacgtcaataccatttctgtaatccgtactcattgacgaaacaccgggtccgacaaattccatcaccttattcttcacatatccattcttaaaaaccgctgtaacaatcgcaatcgcaatatcctgcggcccgactcccggattgggttttccgtctaaatatacagcaatgacttccggatacttaatatcccatgtctcttccaaaatctgctttaccagttcccctccgccttctccaacagccatggttccaatggctccgtaacgtgtatgtgaatcagagccgagaatcatcttgccgcatcccgcttccgtttcccgcatatattgatgaatcacacccatatgcggcggaaggtaaattccgccatatttttttgcggcagttaatccaaacacatgatcatcttcattaatcgtacctcccactgcacacaaactgttatgacagcaggtcagaacataaggaatcggaaaccgctccatccctgatgcacgcgctgtctggataatccccacataagtcagatcgtggctggtaattgcatcaaaccggatttttaaattctctttacttgttccggtgttgtgatcctgcagaataccataggaaattgtaccttctttatactgttcctttttttccaaaagttcttttggggcttcattttctccaacaaccgtttcaccctccagaaggaacacacccgaatcatataatttcattcttatttatcctttctctgattatcgattcagactggccagatctgttttctatatccatattgtatatctctaaatacaatgtgtaaaattcatatttttcatttatttcattcattgaaactatgcttatatctattttttacatgcttaaactcgattttttgttgattttagccaacttctttctaatatttacttaatattccaatttactaaatatacctatttttcataaaaactatagtttgtaactatttcttgtcaacacaaaataaaacgattataatcaatatatcgttaaacgttttatatttatctacacattaataattttacagaaaggaatcatttcatggattttcgagaattgaattacgtccttgcaattgaaaaatatcagaacattaccaaagctgcagaatctctttatgtaagtcagcccacattaagtaaatttcttgcaaacctggaacacgaccttggccaaaaactttttagaaaacttggaaataagtacatcctgacttttgccggacaaaaatacgtagatacggcaagggaaatccttcttttgaaatcaaatttggacatcgagcttgccgacatcctgaaaaaagatgtaggtgttctcaacgtagcctttccccgcatgcggtgcacctacatgcttccggctacattacctgtatttcaggctgaacaccccaatattaaaataaatgtctttgagggaagttctgacgaaaatgacaaacttttattagaaggaaaagctgaaatcgcattttacagcaagccggaaacgctgaatccattaatcgattatgacaccatacgtaaagaagagatgctcatctgcctctgcaaagatcacccgcttggcaggtatgcacagcccaatccctccagcagatatccacgattagatccaaaactattgaaaaacgaattgattctccaactgatgcccgaacagagaacacgacagattaccagccggtatttcagcaacataggtctaaactttgaaaatgtcatgacaaccagcagtctgcctgctatcatggaactggtttccgttggctatggagcctcatttatattcgagacccatctcatgcaccaccatttcaccaaatccattgactgctacagtttcggtgaaccccagaccttatccgactttgttgtagcttccagacacggaagttatcttccctcctatgctcacgattttattaaaattgctcgggatctttttaataatagcaatttatagatactcccaatcagaccccagctgcaaactagagcgtgtttgaaaattgctttccgtcggctgtgcgtcccactttgtgggagatttggtcccgatgatggaggcgtagcgggctacgctgactgaatcggggccaaatataccgcgaagtggggcgtgcagacggcgggaatgaattttcaaacacgctctagggttcaagcggattcgggaatctgccggccggtcttgatctgtcgcatgtcaggtttcatgaccagccttagcaaccacctctttggagattgccctgaccgcgggtcctgttcttagatgcgcgtctatcctgtcattgctgttttcatggctcccagggcgtaatcatttatccaccctcctggcacttggttcgccttttactgctgcggtatcttatcttaatagggtcagttatcataattaggtacttcaatttaaccggtggttaataatccccatccaaacattacttcatattaatcccagatatatcaaaagccccgggagactcatctcccgaggccaaggtttcttaatgccgatgcatggaaaactcatccatcggatacttcttcagattctccagtacgcgcctttcctcagccgcgccaatcagctggtcccttgccttcttggcttccacttccgtcttatgacggctgggaccgcccacgcagccgcccacgcaggccatgccctccacaaagtcctccggaagccttcccaccttcatgagcagcagggctttcttgcactctgcggcgccattgcagcgggccaccttgatgtcggtgctctcttccatctcctccaggcactggagcactgccgcggtaacgcctccgccattgccaaagcgtttgccgaatacggagctttcctggtagtcattctcagccggctgcagttccacgccttttgcgcgcatcatggcgcggatttccccgaaggtcatggcatagtccgcattgccttctatgttcaggtccaggctttcgctcttcttggcaatacacggcccgatgaacacggttatggtttccgggttctggctctttatcatcctggagacagcacacatgggggatacggtggtggacatgttctccagcagcatcgggaaatgctgtttaatcatattgacaaatgcgggacagcaggaagtggtcatcttcttgccttccttatgggcctttgcccactcttctgcctcgtaggcagctgtcatgtcgccgcccaggccgacctccaccatatcggcaaatcccagctgcttaagggctatcttccagctggccatggtaatgtctggcccgaactggccttcggtggcaggggccaccatggcaaccacgcgctttccagccttaatcagacggatcacatccaccatgaatgtcttggaaccgatggcgccaaagggacagctgtggatgcaggctccgcactggatgcatttcttctcatcaatcacgcagatgccgtattcatcatatgtgatggcgtccaccggacagattttcttacaggggcgctccagatgggcaattgcgttgtagggacaggcctgggaacatttgccgcactccttacacttggcagggtcaatataggcgcgttcacggcccatgctgattgccccgaagttacaggaattctgacaggccttccccatacacttgcggcagttgtcagttactatataggaagcaatgggacactcctcgcatgccgcattgatgacctgtaccacattggaagtgtctttgccggccggacatttcccctcggcaaggcgtaccctctgcttgatgatttccctctccttgtagatacagcagcggtaggttgcctgaggtcccggaatcatggagtaaggaatcccgtcccgcttttcttccagattcccatcccatgcagccttggccacttcatagagaacatcatgcttcagacgcaggattgtcgcatcattggttaccatttcttctcctcctcattatgagcacctggcgctacgccgggcaggtcccgggggaatcatccccggtatctgtctggcacgcaccagattgttaattttatatcaacacctgaaaatctactatatttatactgaaaatgcaagtatttattaaggtacaatcctaataataggttaccaccacggttttccccatctcttctatcacatgcttaagctgttccaccaggttctggcggatgcccaggtcaaatggcaggcccggattctggtaggcgctgttgattgcctttcccacatagaggtgtacctcggtacaatcctcaatcaataccttggccaccatggagccgccgttgggcttatccagttcctggaaaaactcttccgatacagtctcattcttcacatacctgcgcagcagctgaagcacgcggttcagtgtcagcacgccttcggtcaccaggtcaacaccgtccatatatgcaatgggcggaatctccgggtccacataatccagggaaacatccagctttttccccatcaccctggacacgatggttgcgctggtcccgccgcacacaatggtcttggcattggaatccgccaggaattcatggaccatccgcacatcgtcctccgggttgcgcgcgggtccggtcatcagatgcacgggcttgctgtcaatgatgcgcatacaggccaccgttgtatcgtcacccggcctgaactggtagagctcatcacatgccctgctgatggacgcagccagacgcatggcggatacagtaaggggatactggcgcaccgcgtaatccgcaatgtcctgccacagccagccaaagttcaacagctcgcccacccccgcgtggatggttccgtcactcatgaggatcagggcatcacccttctgtaccttgaacctgtattcgttaatctccttgccctggatgacgcggacattcctcggtatctccatgagcctgccgtcccgtatgaaaatgcagcccgggttgtcatattccaccaggtaagcgtccccgttgtgatacacctgaaggatgctgaaggtggagtaagccacctgcctcacctggcagatcggaagtgtctcactgatggtatccacacattcttccagcgtggcgccgttgaggaacatggttcccaatatcttggaagtcagggtggacagaatattagccttgacgccgctgcccatgccgtcggccaggatcatgatgttggaatccgcggtctgaagcagttctaccttgtccccacagaggatttcggtatatttattcaggcttttataagcaacatccactgtaattcccattatctacctccgttgccgcctggtttcttcaaatcagcgctgttcagatggacgtaccctgtcttcctgcctgcgggagccgcgcttccgatatggacatagccctttttctggtcaggtaccgcagcattccctgctatcccggcaccgcctgccgtccccgcgccggccccggtattccccggcgtcatgacgccgcttaagggccttgccccgctgccaaggtgcacgtccggaagcgcgatgtcttcctcaccgcccccgtagatgccgtcgcttccatcctccagcagggaatggcagagcttggtcagggtggtcttggtctcggccgttgtctcgcctaagagtccggctatctcctgggccaccatcatctgtttatggattatcttctgggccaggtcaatggtttccagtttcttctcatactcttccttggccagctcttcctccctggtgatatcgatgaaggtggcaaggactgcattttccttttctatgtatacaatgttctgtaaggtggaaaggttgtattccggatagttcacccgcttgccatggatgttctggtgcgtgtcgaacacccactggaaattagccgggtcaatcagctcgtacaggtacatcttaagggcctcggaacgtgtcttgccaaaatacttctcccccacatccgagtactccagtatccgcatgtcgtcccctacaatcagcacgatgttgggggaagtctccattaccaggttggccatggattccgccttctcatgcatgaacgggatgcacatgctcacctccgccttgtgctggaatacggcaatggccttctcacggcaggtaggatagccgcaggcgccgcagttcagctcgtcttccggcttaagcttgttggtcatgcgcaggatttcacgtatctgctcttccgtgggctgtgtatccctgggggagtggtcctcaaaccgcttgccgaaatgcacgttctcccacaccggctccatctggcgctgctccgccggttcccgcgcaatgctctcctccatgtccagcttgaccttgaacctggaaatgaattcgtcatttaccgtaggtcccttgatacatccgccggaacacatattcatctcgatgaagcatccgttaatctcgccccgggccatgctcttgcacaggtcgatgcagttggccacgccatgtacatagaacttgcggtagccgtcgctctcctcctcggttgccagcacggagcttaccactccgttggtcaccggatacaggcggttgaccttagggtcaaatgctgtaaatggccggtcctcacagtcctcgatgacaatgtcctcttcctccagccacttgttgatatcattaaagttcagcacggcatcaatataaccttcatgccgcggatccttggactcctttttcttggcaatgcacggtcccaggaacaccaccctcacgtcccgcccaagctcttccttcagaagctttccgtgggcaatcatgggtgataccaccggagcaaggtacggtaccagctggggataataaatctccaccaggtcattgacgcttggacagcaggtggtaatgatgttatccatcttatgttccctgaggattctggcgtattcagccgtcacgaaggcggcgccctccgaggtttccctcacatcctcaaacccaaggcgcatcagcgctccgcgcacctgcccgattgtcttatattttaaaagtcccatgtaagccggcgcaatggataccactacccgcatgccttcccgcaggaacccctttaccatatccagatcgctccggagggtcttggcggactggggacatatcttgagacaatgtccgcaaagtatacatctgtcaggcatgatgaccgcccgctcatcctttacctggatggccttcacatcgcagtagcggacgcatttgtagcagtgcttgcactttgtggctttgaaatcaatgatttccatgcccataatcaaagtctcccttttatctcattctcgaaaaattcctcggtatcttccggtttcagtgaatagagctcaccctccacggtcacacatacgccgtggtcacagttgcctgtgcagaatgcgccgtttaaatccacctggtcagacaggccattctcagcaaccagcttctgaagctttgcgataatctccctggacccttttaaatgacaggcacttccaatacaaatcgttactttcatcccttattcctccactatctgcgtgtattatgagttcaccccaaacggtatctccattatctcatattgtgatatttatatcaataatatttctcaaatattttatagaaaaggagggcctgttgtgctatagtaaaggatatttatgagaggagagattgtattatgaaacgttccatttccatacttttaactgcattcctgggcgcttccctgatgcttggcggatgcggcggatccggacagggttccgctgccaaggacactgccgccagcgccacacaggcagaaacccctgcccctgattcccaggagaccggcagcagcgggtcagaggataccgggtcttctgaggatagcgggtctgacagtccggccgggtctgccaaggagcttaccgcggacggatccggggatgagccgaaactgacctgccaggccggaatccgcgtgggttccctaaaaggccccacctccatgggcctggtatccctgatggacaaggccgccaagggcgaaacctccaatgtatatgaatttaccatgaccggcaaggcggatgagctggtaggcaagattgcaaacggtgacctggacatcgccctggtgccggccaacgtggccagcgtcctctacgccaagacccagggaaatgtaacggtcctggacatcaacaccctgggcgtcctgtatgtggttgcatcagatgattccatcacatccatggcagaccttaagggacggaccatttacatgaccggcaagggcaccacgccggaatatgtgatgaattacctcttaaaggaaaatggcctcggttccggcgatgtggacctccagtttaagtctgaagccaccgaggttgcctctatcttaaagcaggattccagcgccatcggagtgcttccccagccctttgccacagccgcctgcatccagaatgaggatctgaaaaccgttctggacctgacggaacagtgggacatgctgaacaaggacagcggcagcatgctggtaacaggcgtcaccctggtgcgcagcgacttcctccgggagaaccgttcgcccattgaggatttcctgaaagaccatgcggaatccgccctgtttacttccggacatccggaggaagcagcagcccttatcgctgcccagggcattgtggagaaagcacccatcgcccagaaagcccttccctactgcaacatcgtatgcattacaggacaggagatgaaggatgcattaagcggatacctctccatcctcatggaacaggatgccaaatccatcggcggccagatgcccggggatgacttttattacatgccttagagcgtgaaggcccccaggggcggataccatatgactggttggcggagacatttttcatgaatcaaaacacccgtatacggaaatatttcatctggctgttctggattgcagtgtggcaggcagccaatatgctgatacacaacaatatcatattcgtggggcctgtggatatggtaaaggccctcctggagcttgtccgcgacagttccttctgggcctctgtcttcaactcctttgccaagataagcatcggattcctaggggccttcatcctcagtatcctgttaggctgcctggcctatgcggttcctctggtaaaggatctgctggagccaatgatgatgctgatcaaatcagtgcccgtggcttcctttgtcatactcgcccttatctggatcggttcccataacctggctgtatttacctcctttctggttgtggtccccatgatatacgtaagtaccctgtccggccttgagcacacggacaggaagcttctggagatggccctggtattccggatgcccctgttgaagcagatacgttatatctatattcccgcagtgctgccctacctcatcagcggatgcaggaccgcgttgggaatgagctggaaatccggcgtggccgccgaggtaatcggcataccggaaggttccatcggcgaacagctctactattccaagctttatctggataccgccggactgtttgcctggacctttgtcatcatcatcgccagtgctgtttttgaacgccttttcctgtatcttttgggtaaagtaaagcattagatgcatttagaaagttaggagccacagagagaatgattgaactgaagcatatctcaaaatcatataacggcatgcccgtccttcagaatatcagcatgaccttccgggataacggctgttactgtcttatgagcccttccgggtcaggcaagaccacgctgatgcggattctcatgggactggagaaaccggacacgggtaccatagggatatccgtggcggatgccggaaggaacgtggacaccggggacagccgggacgtcagccatggccggacctccccctccatatcggccgtattccaggaggacaggctgtgcgaatccttttcccctctggagaatgtgacgatgtgcgcaggacgctcaataaaggcgtcccgcgtcaggtgggagatgggaaagttattgcccgaggaatgcctggaccgccccgtatccaccttaagcggcggcatgaaaaggcgggttgcggtttacagggcattgctcaccccatcggatatccttatcatggacgagccttttacagggatggacgaggaactgaaacacagtgtcatcgcgtatatccgtgaaaaacgggacggacggatcctgatactctccacccaccaggaggaggatgtgaagctgattggcggcgaactggtgcggcttgcctaaacggatgtcctccccatgtataattggataccctatatataaacggatgctgcctgccgggcaatccccaggcaggcagcatccacaaaccatccaatcatctatatatccattttcatatcatttcccggatagaccatgcataactccgctccatcctcaacatccaccttgtagttttgtaccgatgctgcaattgcgaagctgtccccctgtctgaaggccatcctgcatccgtccgcttccatgacgcacgccccgcgtgtcacgaggccaatggtaaatcggccgtgatggctgatgacggagtccttcatcacttctatcttccccacataaaagcagggcgtgaatgtttcatttatcagaagcagttctttatattccgggttgtctttgagcacaaccgggctgaccttacatttcctgactatatcctcttttgaatattcattgtagtcaaagatatccagacagaagtcaatatcccttcccatgaaccgtccttccttgggaacgatgatgccttcgcgttcaaattcacaccggaccaccaggtcggagggttccatgatttccagcagcgtaatcccctctccgatggcatggggcattcctcccggaatataccatacctccccgggctttaccggtatcttctcaaaacacgcctccatccgttccttatcctgggtctctatgatatccttccattcttccctggaaggggagtgctggaaccccagatagatatacggttcaatatcctcgcgcaccctcaggatataatagcattccagcttgccataccgcttccccatgacggacctggcaaagtccgacgtggggtgagcctgtatgtgaagccgcatggaggaatccaggattttatagaggaaactcagctgccagcttccatctttgcgcatgcagtcccccagatagtattccttttccccatctaccacatccctcaggtaccgtttcccttcatccgtatcaacctgaatcagtccttcatgctcaattacatccatgcccggattcacagcttcaaccatggaccccagccactcctcaggcctgtcgttatcaacacataccggttccccgtgaagccggtcaatcccagccccgcctaaataatttcttcttacacggttcctcggaagtttaatcaatgcttttttcatctttaacagttctcctttcacaaaacagacgtcattccagtcacatcagcccgccatacatcacatacacggcggcgcagcagatgattcccacaatccagcccgcaggtatggacattttcatataatcctttgccgaaaccttggtatatccgaatccccacgcaacccatgactgagtaatatccagatgctggggcgcaatggtggtgatggcgaacagcggatacaggaatgccaccggcgcgcctggaagtatggctatgacgaccgccaggattgccgtcccgcatcccaccaggttcatagggccgcggaaaaagcccagcggggtaaggactgcaaacgcgatacacagggtaatggctgtccttggaatgaacccgcccagtatggaggtaaagtaaggggccgcaaatgctgccgcattattaaacatcgcaagggtgagcaggaagcctaccatgggcgccacatcaatggccccttcggtaaacagcttagccaggatctgacatacgcccccatacgaacctttcagttttcccgttgtcagtaatgcgtagacgcctgaaaggcagaatcccaggataatcggtaccttaaacagaaccacgccgagaacaggaagtatgaccgatatccatgatatgaccggggcatcctccctcacggatgcagacgatacggcccagccatgggatacccctttgctcatggacaggttggcaacaatcaataccaccacaagcgcaactatcatgcacagcatcccaatccggaaataatcattgtatgtatagctttcggcagctggttcgaagcccgcgtatatggtctggaactggttgaaattaaccacattggcaaaaatcccggccatgatggaacccatgaagctgaacagcgccaccggtgagggaacccccaaagacagcaggatcggcaggacaatcacggcgatggaaataaccggaccgattcccgtcattgacatgaagatgattgcagtaacgatacagacaagcgccatggtaatcctcggcttatcaccgcccagctcaaccaccttccggattaaggttgcagcgattccggtatccaccagtatccttccaaaaaacgctccgaaaaacacgttgaccagaatggatttggcatatcccgccggaccgtctgcataaacgtacgtaagcacatcaatgaggcttttcccttccatcacggtcgtgggattcagcaggttgccaagcagggataacaccgtccagaaggttgccataagcgcaaaccccaccatcaggttaaggcccttgacacaataccatatcattcccacaaaagacagaaacataataattccgattataacatcgatacccatattactccctcactttttagtttttgcaatcgattgctaattgatgcaatcataatatcatatatttctctgttttacaagctgttttttatatattttaactattattttaagtgtttttttactgttagttcctaatttttacatatttttataatttaggattcaatttcttggcaatcgatgtaataattgtttcataataagggggacccatccggtaatgcagcaatccccggccttccccagtccaacaataatcatgataggtaataaaaaagcctcctgcaatcagataaaatcacagaagacttttgtatccttaaatgcacaaaacgcaacaaattagtacgaattactatgaattactatgaattactatgaattactatgaattaccataaatcatcatgaatcaccgtatatcgccatgaattatcatgatttccaatgaatccatggaccaaactgccctccgggccatagattccattccttttccgcatccgctcacccatccaggcacgccttcagcctgtccccggtctcccgtatgcgctccccgtcccggctgtccagtgctgcttcaaatgcctgcatcaagctttcaatccggctcctccgttcccccgtgctcttctcatagcactgctcccctaataaaagcaggagccggttttcttcctggtccctgggaggaatcttcagataggaaagtgcctccatcctggccttgatttcctcgtccgtcatggtgttatgcctgcccttgatgatctgtttcttcactttcccggtggaaaccaccttcacctccacctccaggatggaattgatgtcataggtataggtcacgtccaccgcctctgcccccgccgtgttcttcggcacctggatatccaggcttcccagcagcaggttgttggcggtgaggcggctctccccctggtacacttcaatgcgtatcctgtcctggttattgcggattgtgtaaaaacgttccgtgcggctggcaggaatgaccgtattgcgctcaatgattgggcagaaatgcccggcctcatagacgccttcccggcgttcccgcgccacctcggttcccagggtaaacgcgcatacgtcggtcaggatcatttccctgacttccctgttcctgcttttcatggctccctggatggcggcccccaatgccacggcctcatccgggtgcacggacacatccgggaacttatggaacagcttcaccacgaaatccttaaccaccggcatgcgtgtggctccgcccaccagcacgacctggtcaatgtcctgcagcttcagatgcgcgtccgcgatgctcttctggatgggcctgcgtatgcgctccagaagcggctggcagagcttcccatattccgtaagtttcatggacaggtccttttcctccccctttatcctgcagcgcatctttacagtttcttccaggctgaaccgtttcttggagttctccgccgcctcatggacagccgcccgctccttccattccagcccatcctccttaagcccgttcctttcataaaactcctgttccaatatcctggtaaaatcctcgcccccaagatagttgtccccggccacggcccgtacctcaaggattgggccgctaagttccaggatggacacgtcaaaggtgccgccgcccaggtcaaacaccaggaatcttgtattctctgttttatcgtacaggccgtatgtgatggcggcggccgttggttcgctgataatccgctccaccttaagccctgccagttccccggccagtttcgtggcccttctgcgcttgtcgtcaaaatacgcgggcacgcttatgaccgcctcctggacctgttcgcccaaaaagctttccgcatcctccttcagggaacgcaggaccatggcggacaggtcttccggccggaacttgtgcccgcccaggtcatattggcgttcgcttcccatgaaacgtttgaataattccgctgtccgctccggatgaaggaggccgtattcccgggcagtctcccctaccagtatctgcgccttcccatccaccgccaccacggacggggtcaggttcttcctcaggcggttggggatgatgcacgcccggccatccacaaagcaggcggccaggctgttggttgtccccaggtctattccgattatcattgtatgcacgtctccttttccagcattttaacagccatccgggcatctttattgcatcccagccagatgacctggtctgcccgggcaaatgccataagtgcctcctccttcttatggtccagcatgagcaggaatcccctggcttccaaaagttccgtacacccgtcctcatcgcaccaccagcacatcccccgctcctcatccatcagccggaaatattcccgggcctcatcatggcgtcccgtgaaataggaccagcagaacagattataaagcacctgcctggactccgtggtcggcctggtcagcagttcctccatggagaggcccaggtcggaacactccgtgtagtccgactccagcctggccctgtataaatccccgaatttcctggcttccttaaggtcattcctccagtaatgggtccgtatgagcatcttggtcaggctccggtaatagccgtatttcttcatccggctggctatgtcataggcccttgagagataatccagggccttatccagattgccgagataataccatgcctcccccacgttctggcacactaaggcccggccttctttgtctcctgcttcatccgccagcgcctcccgtgcaatgccctctgcctcacggcatttatcccagatttccccgccggggtttttccggaatttcagccagatattcaatacggcctcaatccgttttccttcttcctcccaatcatcacagcaccttttatccaggtccgcgcttccatattgctcccttatccacccaagggccttgtcgtggcgcccggcctctgcctccaggtccatcaggttttccaggcatttttcccggccgtccgctgtcaggttcctgtccagggcttttgtaaaatattcaattccctggtcaatctgtttcattctgagaaagcactggaatacccgcttaaagcattcctcttcatccgccccgaactggtcgctggcttccaggcttttcccacagcacgcaatggcttcctcatatcttcccaggacccggaggatttttccctttaaaagccacatgccgctgtccccgtccattttaatgccctgttcaatctccttaagggccttgtcatattccttcatgtgcaggtagatatccgcacgccgcctgaagttttctgcccccgggccgaacttttcttccagcaggttggtgtaatacagggctttttccccatattcgttctgcagggtcctggtgtatttctgcttgtagagcacgctgagcctccaatagcagttggaggattccgggttcttttgaagcgccttatcatagtatccgatggccttgtcccattccctgaaccgctcatggcacctggcaatataataatacagcctctcgtaatccatcccctgcttctcacattgcttcaaatgcaggtacgcctgttttggacggttcccatattcaatccagtatcttcccagggcgtatctggctgacagcgattcccggagcctcagcgagatttccgcatacctgcagtccagccccagcttcttatatttgttgaattggttgccgctgtcattcaggaatgcccgcttcaggtaggcatctgccagtaattccctggattccttattctgttccaggtggcggatgaccgccgccgcataccggtccgcccggcgccagtcctccgcgtcttttgccagcctgtccagcaccccaatccgctccaccagcagttcactgctgtttaccccggcctgtcccgcgtcatcaatgaccctcagggcattttcatactttccgtatgccttaaatacccttactgcccttatgtatatctccgggtgtccgtcatatatctccctggcccgcaagaaagcgtccaccacctcctggtccttgcccagcctttcgcatgcctcctgaagataaaagatggcccagtagaccccgtcatccagctggaggatttccctgcactgcttttccatctcctggtaatcctgtctgtcccgcaggaccatcaccttgtacagcctgtagtccacgttatccggttccagcaggacagcctggctgtgggcagccagcgcccggtccgaaaagcccgcggcctgctcccggttcccgtcttcccgccttatctcctgatgatagaggtcccgccatacgcggccttccacgtggaagcttctggcctggctggccttctggccgccggattcctggcttccagacttctgatcaccgttttcctgaccgacgttttcctgaccaacgttttcctgaccaacgttttcctgaccgacgttttcctgcttaagacgcttgcgccacagccctatctcctcaagcgcctccccgctcctgccgtccagcatgttaagcatggccatctgctcatgaaaatccggcgtgtccgcgatatattccggatgtgcctcaaagaaccgccttccctcaccgccctgttccaaatgaacaaagcagcgggcaagaagcagggcctcctcctgattaagtccttctgtcctggatgtgtaaaggcggattatctcctggtccgcctgtcccaaaagcctgcgcgcctcctcggtgcgttccagcttcccggcattccacacatgttccctggccttttcccaatttccctcctctgcgtccagcctggccagacccataagggcctggtaagccccatcggacgtccgcctcttcccgcacagataggctgcatacagtcctctggcctctgtgcggcagccacagcttataaggatggaaaccactggcatgtaaacctgctcatcctcccggttttccataatcagggaacgggccatcccggcagcctcctccgtcttccctgtcagggccagatattcagcctgctccacaccataccatggatggtctatgcccagcgacgccagatgcagcagcgccctgcctctttcctccatttcctccggggcgcctgtcttctccttgttccgcaatgtgaaaagggcgctgatgaagccatcataatcagcctgtgtgtctccctgaagcctgtccatgggaaattcccggccgtcatccgtatccagccgttccagcatgaaatccacgaatccctcaggcagatgctccctgaactcctgatgattcttttcaataagaaaggtcctgtctaatattttccatatctttacaggcaatctgaagtgctcagacagatatgagaacatggcccatttggccggttccccgctgtccacagacccaagcaccggctcccttaaaaggctgtcccattccgctggatccagacgcctgggcaggctggtgtaaatgtcagccagctgtctcaggaaaatgccttccggcccgctctcctccatccaccctgcactttgtatttcctcatccgcaggtgtcctggcatatccaaccgcttcctcataggcccgcctcaaccgtttaaacccttctgcgtcatcctccggattagaagttaacagaagcttccgataggctgcccggatttcatcttcatcccttgtctcctcaattcccaaaatcccgaatatctcctgaacgttcaagctgctcctccttatggttcccctgacatcttactccttagaattataactgagttttccagtatctgcaagatatcatgcgcccatggctgtaggtcaggacacctgacagtattttcaccagacagcatttccggctgcagttttctcaggcagctgtctgctcccgcagatagaaaacggggatgccataaaggcatttctgcctcctgcatccccatttccccctggtccgttatttggtccgttatccggtccgctatctatcccttactgctggcagggatcggtatgcatatcaaactcagggttaaacgcatagaaattccggctgtccagtttatcctgggtaatcctcaggcactccccaaaccgctggtaatggaccacctcgcgcgccctcaggaacttaatcggctcgcatacgtcatagtccttaacaacacggaggatgttgtcataggtgcttctggccttctgttccgcagccagatcctcatggaggtccgtaatcacatcgcctttggactggaactcacatgcgttaaacgggattccgcctgctgcctgtggccagattccggttgcatggtcaatatagtaagggccaaagccctgttctaccagctgctctgccgtcaggttcctggtcagctgatggacgatggctgccactatctccaggtgggcaagctcctctgttcctatatccgtgagcgctgccttgcactctttgtatggcatggtgtaacgctgggacagataacgcatggaggctcccatttccccgtcaggtccgccgtattgggacattatgaactgtgccatctgtgcatttggttccttgatattaacaggaaattccagtcttttttcatatatccacatttatgagcacactccttcccatggccatggatcgctgacccaggaccagtattcagtatccttgttggcactggcggtcaggggaccgaactgtgcctcatatgccgctgccgcactctggtatgctgccagcatctgattatagtaatcaattgccgctgcatcgcagggatgggtgtctaaatagaggttggcgtcaaccacggcaaaccctgcctcatctacctgacgcagcatggctccctgtgaaacattataatcgaagttggtcatctgccgcacctcccataattaaactgaagatccaggtcagggaaaatggtcccctgtaccagtcccctttcaggggcataggtggtctgccactgctgccacggaacataggccattgcaaccgggtgctgctgttccagacagcccggctccgttgacacacagtccatctgattcatatcagggtactgtacgcccatgaatgattcagcaggagctacattataatcattgtttacagcccagggaaatgtgttcatatccggataatccgtctgcctgaaagaaccgcagctattagggccggaggtgttgcaggacacgtgtctgcagccgcagccgcagcactgtccccttacatctgtataagagtccatatgatggaaactccttccattaacttttctttattaatagtttatgtggttcccaaaggaccgtgacagaataatcccctgaaacaatcagtaacactttgtctgactgtcccatatgatatagtacaaaccaataaaaaaggagatgcgatatatgtgttgttttagatttggatgtggatgtagatgtaatcgttgctgttgtggatttggttgtggaaatatcggctgtggctgcggctgcggtaataacaatagtggatgcggttgtggcaataacagcggctgcggctgcggatgcggcaataacaacagcggctgcggttgcggcaataacagcggctgtggctgcggctgcggcaataacagcggctgtggctgtggctgcagacgtgacatctgtgcaggtgagagacgcagggcatatagggaaggcttccgcaacggatactgggaaggcttcaatgacgcaagctggggaaggccctgtggattccctcagccccgcggcggcgctgcccaggcgccggttgcagtagatgcaggcggatgtgggtgcaacaactaaacagctggactgacagctgatattaatacacgggggttccggttggaaccccctttttcatgaccctttttcattatatatccctgattatgcgtttcacggcattgacaacccctgcagccttggtttatagtgttctttagattattttcagcggaggagaaaaacatgaacgcacagaaattggaacagatacagaaggtctttgcaaatgaccggtttgccactgataacggcgctgtcatcgatgaagtagatgatggatatgcaaaatgttcgttggaaatacaaccacatcacctcaatgcgggaggaaccgtcatgggcggcgccatctttaccctggctgattttaccttcgcagtggcctccaactggaataaaccgcttaacgtgtccaccacttcccagattacataccttggcactgcaaaaggcacccgcctggttgccgaggcccgcaaggttaaagaaggacggagcacctgctattacctggtggacgtatccgatgacctgggcaatccggtggcccatgtgactgccagcggttttataaaaagcggcacccagctggttaaggatttgccggcacaagcatgattagacaggcttttctgtcagttgtgcatcccacagagtgggatacacttcaccttaaaaatgttcctattgttttacaaggtacatatcgatattccatcatcgctttcatacctgcctcactggcaccgtcaacaaaaggtaatgcccatgacaaaaggcgccctactcccgtagaacgcctttcaatacgtacctatactttgatattcatgggtttgtcaccccctcacaaaacgttgaaggtgccaatattatttcttatggttttccggaaagaagccagcctttcaggtcatgcaatcataaatgtaaagaacgatgggaatagcgcaattaacagcaataccattacaaaccccataaaaaagggaagctcgcctcttgtaacctcgccaatggacagtttcgatatggaacatgccgaaaagatatttaccgccacaggcggcgtcattgcgccaatcacgccggccaggcacacaatcaggccaaattcaattgccgtcagccccatggacattgccaccggccataaaaccggtaccaacaatacgcagattgccgttccttccagaaaggttccaaagaaaagaagcaaaaccgcaataagcacacaaaacagcttgggactcatgttcagggcaacgattccagacaccatggcatccgacatgtcagaataggtaaacagccaggaaaagcttgatgctgttgcaataatgaagagaatcattcccgcgcttttggcagagttcagtatgattttaggaagatcgcgtattttaagctgccggtaaacgaataccccaatcaggaacgcatataatacggccgttgccgaagattcagtgggggtcatcaacccgctgtaaatcgaaccaaggatgatgaccggcatcagcagggctggaaacgcacgtacgaattttttccaaatctggctgtaatccaacttaccgtccatcctcggccatgcctcacggtgtgaaaagtaaaacacctctgccgacaggatcaatgcaatcagtatcccaacgaagatacccactgtgaacatatttgtgacagacgctcctgtcaaggtacagtagacaaccatgatgatgcttggagggattaccggccccagaccgccggacacagccagcaatccagcgcagcgttcctttggataccccagcttcaccatctccggatacagcatggaaccgattgccaggaccgtggccggtgcggaaccagacagggcggcgaaaaacgcacaggccactattgccgcatatcccaatccgccccggatatttcccacaaagcagttgacaaattcaacaatcattttagaaataccgccgttggtcatcaggtttcccgccaggacaaagaagggtatggccatgattgaaacattatccatggacgtgaacaatctctgggcaataaccatgacaggaaggtccggataacaaaacagtattgtggcggccgcggccgctcccacagaaacagagataggcactcctatcaaaagaaggattaccaatatcccaaacagagaaaacgcaacctgccccatcatatattctcctccccagtctctttcttcccgaataatttacgtaccatgacaataagtattcctgtttccactaccgaggcaataccaaagctgaccggcagggctagatatggaatgaacatgggtacctttaatgccggggacttctgccagttagacatctgcccctgaataatcaggatggcctgagtaaacataagtgctgaaaacaggaccaccaccagcttcgcaactatggcagccacttcttttatcctgccatgaagcctgtccaccactgtggtcaatgccatctgggaaccgtcccgcaagcctaattccattgccagcagcgcaagatatacctgacaataccgtgcaagctcctccagccatcctatgggcagatgaaagaaatttctattcaggacctgaacaaaggatgccaggctcattataatgaaaatcataaccaccattaattcttctaacttactggcccctttaattatattttttaattctctcatgttggtcctctcctcatatatcctcgtataaccgccccttactgcagcttggcaagctcctcattcatcagtttcaaagcttcctcatcaaaactgaactgcttcatggcctcttgtgtgcggctcttcagttcgtccaggtccaggtcaaagaatgtcactccctggctttccagatcggtcctgaaatctgccacggaatccctcaacagggttctctggtactggcagccctcagccgctgcagcaattaccgcgtcatgatattcttccgggatcttagcccacagatcatcagaaaacacaaggtgctgataagcgaatatcaccggctggttgcagacataattacatacttcattaaatttacttgccacaatggtaggaatggtattctctgccccatcaatggttccctgctgcagggcggtaaacacatcgccggaagccatcggggttgcaatacagccaagggcattgtatgctgccatatggtattcattctccatggtccggattttcaatccttttaaggaagccacggaatccacattcttttttgtaaacagggaacggaatccggaatccatccacccaacgattttgaccccgccggcctccgccttgtcctccacataatcgccgaatgggccgtctataaatttccatgcctgatcatagtcgtcaaacaggaacggctggtctaaaaccgcggcctccgggatgaagttcgtcaggacggcattcgtaatgatacatgcgtcaacggtccccaactggcacccttcatacagatcgcgctcatttcccagggagttgctggggtataatttaaaagtaacctgtccctgtgtcgcctccgtaatcttgtcacacatatactggtatcctttatagtgaacgctgttttctgattctgcaaatcccagctttacctcaatcttctcttttgcggtttcccctgaaccggccgtttcccctgaactggctgctgcctgtgtctctgccgccgcaccgcctgtagccggtgtattttccttcggcgctgaattcccgcatgctgtcactgccgccatacatactaccactgctgccgctgttatcatcctatggattcttttcatcataatcttacctctcctttgtacattcatttacttgcccgccgggtttccacccacgattccctcttcatccagcacggtcttaatcattgcgttcatcatggacagatcgccgtcttctatcaggaacccgccgcccctggcattctgttcaattgcttccaccctgcgcgatccggcatccacattgatatttggcgcctgctgaagcgtccatgcaatggtcaggcccgcctgggtcgtcccatacttatcgcacaatggtttccatgcttcaatcaggtcaattatcctcttcctgcgctttggctgataccatacactccattcattcctggcgtctcctggcgtcaccttgctctccatggtgtaagctcctgtgagaagccctctttccagcacggagtatgcctgatatgttatattgtgttccaggcacaggccgtttaaccggtcgtagctggttggatccagcatgctgtaacgctcctggatcaggtccagctgtccgtactttaagtactcccggatatcctccgccgtcacattggaggcccctattgccctgattttcccctcttttttcaggtccatcaaggttcccattgtctcttcaatcggggtaaatgccggagggaccgactgccagtgtgtgatatagagatcaatgtaatctgttttcaagcgtctcagggacccttccaggctgcgccggacagccattggggaaaggttgcggtatatctgatgcccatcccttgtaaaaaaaggagagccctcgccggtatcccactccaagccgcattttgtcgatatgaaacacttatccctgcggccctgcagcgcctgccccaacacctcctccgcgtggccaaacccataaaaattagaactgtcaaaccagtcaatgccaagctccaatgcacggtgtattgtgcggattgacacggtatcgtcatttgccccccacacgccgtcaccgccaatggacagtgtccccatggaaatcacggatgcctccatccctgtattaccaaccttcattcttctcattaatcctgcacctctgcctttcacttcatcaaatccggatttattctgatagtctaatactaacaagttttatttctaaaaaatatcccgatgttgacaatttgttgttctatattgccataaaaaatcccaacatttcccatgtaaaaaatcccccctctttcagcagggcgcttttcatgttataatcttactgttaaaagcaatctcttttatgattcaggaaccggctaaccgaaaggagcactgctgcatgaaaataccctacacgattgtcatggaatcacttcaccataaatctcttagcgaaccgcacttccatgatgaatacgaacttttattcggactgagcgacggcgggacctacatgataaacggacacgcgtaccctctctgccatgccatgctctttgttttaaataaatacgtactccatcaatgcattgccgatatatcctcttatgaaaaatacgtccttcacttttcttccgagacacttaagatgctgtccagtacgcagaccgacatagtatccattttcggcaactttgactatattgcacagcttctaagcgaggagcagtttcactatttcaataacctcctggcaaactgcatgcccaacggcggcggattcggcgatgacctgcgccagaatatggcatttgttaatcttatgctgtatatcagcaacctgatcagacagagggagtctgtcgtgggactgtccctgaaaaacgagtacaactccatcaagcctatttttgattatatccataatcactatatggaggaaatccgtctggaggaattgagccagaaattcttcataagcaaatactatctctgcaggcattttaaagccctgaccggcttcagcgtgggttcctatgtcacaaactaccgtatacgtgaagcctgcatcctgttacgcaaaggctattctgtccagcgcgcaggggaagaggtcggctttggaaacaatgcttattttatcaagacctttaaaaaaaccattggacagtcacctggaaaatatgcaaaaaattattagccctcatatccccggccggctgacgggacaaaaaaggggctgagccctgacagatcatcctgtccaggctcagcccttttcaatttaatacaatccacacctaccagcacatctcctcattggtgtacagcaccagtccgccgtcctcaatggcctttgccgccgccgccccgtcggatgcctttacaatcatggcacgcctgtttgcggatgccagggcatacatatattcaatgttcagtccctggctgcacagtatatgggtcatcttgtgcatctcgcccaccttgtcctccagcttcactgccagcacatcggtcagcatggcggaaaaacctttgttcctcaggccgtccttggccttctcagggtcggatacaatcatcctcagcataccgtactccgtggtatcagccatgctcagcgacaggatgttaatgttctcctccttcagcacttctgttacctgctccagccttccttcgcggttctcaatgaatacagacaattgctttacaaacatatccatacctgcctttcctaaatcagtttcctgttatcaattacatgctttgtctttcccatgctgcgttcaatgctctttggctccaccagcttcaccttgacggccagcccgatagcgttctggatgacatgggcaatcttgcccgtcaggttctccagctcccggatttcatcggagaagaaacgctcctccacctccacctgcacttccagtgtatccaggttattaatccggtcaacaatcaggaggtaatggggagtggtgccgcccatttccagaagggcggattcaatctgggacgggaatacattgacgccgcggataatcagcatgtcgtcggtccttcccgtgaaccttgcaatcctggcagtggtcctgccgcattcgcagacttcgtggttaatgctggtcagatccttggtgcggtaacggataagcggcagaccctccttggtcagggtggagatgaccagttcgccttccatgccgtcccgcaatggtttcagggtcttctggtccacgatttcaggcaggaaatggtcctcatggatgtgaagtcccctgtggaactggcagtccgtcgccacacccggacccatgatttcgctcagaccatagatatcgtgggcatggattcccagctgatgctcaatctgggccctcatcccgtcggtccatggctcggccccgttgatggacgccttcagcttaatctggtcccttacccccatctcctcaatggtttccgcgatgtgcagcaggtaggaaggggtacacatgattcccgtcaccccgaaatccaccatcatggtcaccagcttcttggtattgccagtggacatgggcacaaccgtggcccccatttcctctgccccgtaatgggcgcccagaccgcctgtgaacaggccgtatccataagccacctgtatggtgtcctccttgcccaggccagccatggtgatgcatcttgccacacactcgctccacacatcaatatccttcctcgtatatcccaccacggtcgcctttcccgtggtgccgctggatgcatggatgcgggtaatctgggaattatccactgcgaacatgccgaagggataggtatccctcaaatcatccttggtggtgaacggcagcttatccaggtcctcgattcccttgatgtcgcctggttccaggccctctgcctgcattttcttcctgtaatactccacgttgtggtacacacggtccaccagctttgaaagccttgcgccctgcaggtttgtcatctcatccctgctcatacattcctttgcctcattccaaatcatctgactgtaaaccctccgtatttttaggatatttttaatctgccagccgtaccgctacagtgaaagcgcatatccaatctcaaaggcctgcttattcacttcaatggtctttggcggtacggttgtctcaatcacgcgcagccagtcttccttctcaaagcccatgtgctttgccgccgctcccaggacaatgatgttaaatgcctttggggcgcccagtttcttggcctcggccgtggcttccaccacaatggccctgcgtttcgccttcagtgtctcaatcacatcctcaggataagcagccacccctgtcaccaccgtgatggggtcgatgcgccagtcattgacaatcaccacgccgtcctttttaaggaaatgcagatagcgcagtgcttccaggcgttcaaatgcaatgagcacgtccgcctgcccctcctccacaatgggttcatttaccttgtcaccataacgcacgaaggtcaccacgctgccgcccctctgggccatgccgtgtacttcggataattttacatcatatcccgcattgattgcaagctttccaaggatacggctggtaagaagggtcccctggccgccaacgcctacaatcatgatattctttgaagtcatattattcacccgcctttatctgctcgattgcatcgaatttacaaagctgcatgcacaggccgcagccattacacatggtttcatcaatggaaatggtcccgtcctcattcttggtgagggccggacatccgggccttaagcatgcgccgcacttcttacaccggtcggacagcggcctgcacttgttggggaatctgatgccttttaacagggcacagggcgcctttgtgatgatgacggagacagcttcccttgccacctcgcgcttgatgactgtttccagttccttctggtcaaatgcatccacctcatagacatgttcaatgcccagggatttacacagccctgtgatattgatggcaggcaccacctggccctttaaggtcttgccggtggctgcgtggtcctgatgacccgtcattcctgtggtggagttatccaggatgatgaccgtgccggtggcctggttgtagaccatgttcatcagcgagttgattcccgtatgcatgaaggtggagtcgccgatcacggctacccagttgtggatgtaatccttgccctttgccttctccataccgtgaagggtgctgatgctggcgcccatgcagatggtggtgtcaatgacactaaggggcgccaccgcgcctaatgtatagcagccgatatcccctgccgcgtggatcttcagtttgttcagcacggtgtacacgcttctgtggggacatcccggacagaggatgggcggccttgcaggaacctgggccgcagggtcaacctccagtgtctggcccagcacccgctcacggatcaggttggcgctgtactcgccctggaccgtgaatatctccttgcctaccgctttctggattccccaggccttgacctgttcctccacaaccggctccagctcctcgaatatgtaaagcttatccacctttgccgcaaattcctcaataagctttcttggaagcggattcaaaagccccagctttaacacggacgcctcaggcattgcctccttcacatagttgtatgcaatcccgctggtgataaagcccacggacaggtcgttgtattccacccggttgatgggaagaccatccgcatcctctgccagctgtttcatacgcgcttccaccaccacatggcgcttgattgcattgccgggcatcatcacatatttggcaacatccctttcatacgggatatcaaagggttccgccctgtcctccagttctaccagtccctgggaatgggacagcctggtggtgcttcgcagaaggaccggggtgtcgtatttttcgctcaaatcataagcatatttcatgaattcttttgcttccgcgctgtcggaaggctccaccacaggaaccatggcagcccttgcgaccatacggctgtcctgttcattctgggaactgtacatgccgggatcatccgccaccaccagcaccattccgcctctcacgccggtgtaggccgctgtataaagcgggtccgcagccacattcatccccacgtgcttcatgacgcacatggaacgcacgcctgcgatggacgcgccgattgccacctctgttgccaccttctcattgggggcccactccgcgtaaatctcatcatactgcgccagggactcgctcacttccgtactgggcgttcccggatatgcggccgaaacctttacccccgcctcataggcgcctcttgcaatggcttcattgccaagtaatatttttttctcagacactttatcttccttcctttcactgtaatctccaatggtatgtatctgcctgcattttatcagaccccgtccttgtcagcgcgaaggtccgttacccgtttggccttaccctcaaaacgctggagggtattgggggataccagctgtatcttggcatccaggcccagcatcaggcgcattttctcccgcaggctgtaatccagcttctccagggcagcgtaggagtccatcatgctctctgcctctacttctacttttatggtaaggaggtcggaatggttcttcctgtccaccacaatctcgtagttgggtccaattccttccgtgttaatcagcacttcctcaatctggctcgggaacacattgacgccgcggatcttcagcatatcatccgtgcggcctgacaggttctccatcctggccgtggtgcggccgcatggacatggctcatacatgagccgtgtaatatccctggtacggtagcggattaagggaagcgcctccttgctgatgcaggtaatgaccagctcgcccttctcccctgccggaagcacctgtcctgtcttggggtcaattacctcggcgataaaatggtcctcgttgatgtgcatgcccttaagctcaagacattcccccgatacccccggtcccatgagttcgctcatgccgtagttctgggtcaggttcacatcctccccccagaccttgtgcagttcgccccgcatggcctcggtcatcagttcgcttcccagcaccaggctttttacatgcaggtccttttttgggtcaatccccatctccagggccacctccgcaatccgcatggcataggacggggtcgccactaacagcgtggtctcaaaatccttcatgtacataagctgcttctgggtattgccggtggaggaaggcacaatggccgcgcccaccttttccaatccgttgtgaaggccgagggcgccggtaaacatgccatagccaaaacagatctgggcaatatcctcatccgtcgcgcccccagccaccgcaagcctggccacgcactccttccatacttccaggtcattttccgtataacccacgaccgtcggcttgccggtcgtgccgctggacgcgtggatcctgcgcagctgtttcctgggcactgcgaacaggccgtaaggatagttgtccctcatatcctgctttgttgtaaatggaagtttttccaggtccttcagggtctgtatgtcttccggcttcacaccggcagcttccatcttggcacggtaagcgggcaccctctcatagttgcgggtcaccgcttccttcaggcgggttaactgaatggcttcaatttccgctctggacattgtttcctcttttgcccatatcattttgtctgacctccttttccctgcggccctgtctctgtcgcactttgacgtatcaacgaattggcgcagcgtaatgtctggcgatattataccatctttttttgggtttgtctgctgttttgatgcaaatttcatgaatgtggggcgggtggcggggaggctacgtctgcgaaacggggcagggcggacggcggcggggcggacgcggagttccggaggggcagcttctaagggcctgacagccggaaagacgggggatcggtgctattcgctgagaaactctgaagagctttctcagctcagagcaccttggattcctgctttgatgcaggaatccacccccgcctttccggctgccaggccctaagaagctgcggcctcctccactatgcgtccgccccgccgccgcccgccctgccccgcttcgcagactgtgtattccggccgtgacttagggggaatactcatccataggggagtagggttgtgacggtgaggggtgggtcatttttggaagatatccagggcgtggcttgtcaggccctggacatctttgcgttcgcaggtggcgaagtggtattgcatgtataagttaaattgccgggcgtccatggcgtctatggattcgcgtatcaggagggcgcagccgtcggatgcgacgtagtggagccgggttgtggggaatacggacattatgtggtcgatgtcttccttgcggacaagttcaaacaggtctttgggctgggacctggcggcgaatgtccgggagtcgattaagccttcttttatgtattgcgcgacgttgatggtctggcggttgaatccttcatccaggagacagccgtcggatatgacgtaggctgcaaatatcttaccgccctttttggttacacggattgcttcgcttagggcctggcgtttgtcctgcgtattgtaaaggtggtacagggggcctaacagaagggtgatgtcgtattggctgtccgggtgggcggacaggtccgtggcattgccttgggcgatggttatgttttcgcctggctgggtgttccggcggaatatttctatgttgcggtctaccagttctaccgcgtcaacggtgtagccctggcgcgcaagggcatgggaatagcggccggtcccggcgccgatttccaagatgcgggaaccgggttttatgtatgcctggatgtagcgcatggtggtgaggaattctactgagccgtgttttgaggccagacgggcatcctcgtcatagtggttataaaaatctgttatgtattggtctgttttcatgggctgctccttttatgaatagggtcatacggtacatatatgctgatggatgatgcctgatatctgcgttgggggcagtgggctggcgccgtcagatggaggggttccagtccggattttccggttttatgaatgcggataaaaaatttgtcagcattgtctcggcgctggtcctgctcagtgccagctttttggttgctgtcaggactgccatgccgtgggtgtaaaggaacaggtctaaatagattacctttgcccgctctggttccactcctatagccttggaaaacaaggccgcctttttttcgttgccggcttctttgtagaagtcttttgcttctgacatgtctaaatccatgtcgtttatgaaaagaagcttgaataaatgggtttcttcccgggcgaattctatgtaggacaggggcaggaggagataggggctgacttttacggaattcccataaccggttacatattgctcgtaatatccatatgcatattccaggaatccggcctttaattcgtccatgttttcgtaacaggtaaaaatcggacgggtggagcattgcagtctggctgcaatgcttctggcgttgactgtcccgaatcctgtttctcttgtgatgtctaagacggtatgtaatatcatgtccttggttattctggcttttggcggcatgcgggtccatccttcttttttggttttttatgcaacatatgttgtgtaactattgttgcataataagctggatgtgtcaagagggaagtttgcctggaccgctgattgtcatcaaaacctatttggggaatgcgtatatatggaatcccgcccttgccataacggcatggaacagataaaaaatcagaaccaaaaagcccttatagacgtttggttctgattttgttcccataccatctgttccttaaaagtatggatttaatttttatatatggtatacggatttcccctcgatatacttcgccacgatgttcctgtcatcccctgcctgtatcagccgctcaatcctctcacaggcagaacgccggtttaggtccgcaatggaagtatcatccaaaaccactgcgtcaaacaggtatccaggctcaaagcttcctgcatttccccaaaaactgcctcctccttttgtggccagatagaatgcttccgaccaggaaagtcccttcatgggggcgtccgggtctccttcacgttcttccgctccccatcttacacgggacgccaggattgcgtgtttgattacctggaacatctcaaggcgccccacgcctgccatatccgtgccaagtcccacggcaatgccattattgagatactctcggattggagcggtattggctgcaaacatattacattccgggcaatgggcaaccattacatttctctctgacatcagcttcatctccgcctggttcgggaacacgcagtgggccatgactgccggaacctctgaccccagaagcccataccggtcgtatgcctctccataacattgaaggcccggctccagttcgttcacccacttgatttcatccagcccctcagacagatgggactggaccggaaccttgtaccgggccgccagactgccaagtccctctaaaagactgccggagcaggtaggtacatacctcggagtaatgattggcttcaccgagccatataatccatggcaatccaacagccactgctctgtctcatgaatactttcccgggctgtctcaatcaggccatccatggaattgcggtccatattcacttttcctacatatgctgcaaaccctttttgatacagaagggacataagcagttccgtggccggcctgtggatggtggcaaacatcaccgcccgcgtggtagtggtcttcatcaggtcccctgtaaaacggtcgtatgccctatatgcatagtccaaatccctgtagtggctttcctcaggaaatgcatatatatcaaaccaggttccccatccatccgcgtcaatattgcgtcctaacccacggaatccatactgcggcgcatggaggtgcatgtcgcagagtcccgggattatgacatggctgccgtaatccttcaccggaatatccctgtactgccctggaagttccgggaaaaccccggctgacagcccattttcacatacaatgtatgcctgttcaaagcagatgaaactttctttttcctctgtatatacaaccgtccctttcagggcaaatgtccgttcatccatcatgccgccctgccttcctttttattctttccttcccagaaataataggccggaagtccggtggctactactacaaaagcgctgaacagacttttataaggagcccacaggaaggtggataccagaaggatgacatttgcgcccacggaaagaattgtcatgagcagccaggatggacatttccaggatgggtcatagcccggttttttatgcaggctgaacatggttgcaaatgaaagggcattcttacacagggcaacaaaggagaagaaccccatcagcgcgccgatatcagctgcaaacacaagtatgatggaaaccgcgcaggaatacatgatggagttagccggtgtctcccatttgggatggatttctgcaaatttccggaagaacaggccgtccttggccatggcgtattcaatccttggctggcacatgatggttccgtgcaatgatgctatgataaccacgattgcaataaacgcggtaatgaccccggcggctgagccgataaccggtatctgcgcggctgcctctgccacaggtgcggatgagctgaccagctgtttcatcggaagaagcccggtgacagcagcagccagactggtatagatggcaatgatcacaaacacagtgatgatcagtgcctttggtatggtcttctcaggattcttcacctcacctgccatggaacacgcggttgccattcccgcataggaccaggtggtagcggaaacgcctgccagaagggccttgaatccggttgccgcaccttcaacggccggcgcactgatcatggtcttattcatggaaaacaggcccaccccaataagaagtgcaaagaggagcattttgaagctggtcataaatgtaaggaaccttcctcccacttccacggaacgcatattgatggccataaataccacgatcagtgcggttgccagcagcttaataccgatgccggcaatgcccggaatgaaaaatgcaatataatccgccagcgccagtgccatgatggaataggagggcgggtcccctccccagaacgtagtccatccacacaggaatgccagcggcctgctccctgcttccctgaaccaaacataaaatcccccgtcatccggacaggcagccgtgatttcagcagccaccatgttctgaggtatcatgatgatgcctcctataatgaatgccaggattgttatggctgcgcagccagatgcggcagccacctcaccaaccgaagaaaatatacctgagccgattaccgtgccgactcccagggaaaccactgcccctaacccaagcttcctcttcagttcccccggttgtccattcccctgttccttccccttatccataaaaggacctccttgtcatgtgcttttattttgactgaatccagggatgcgcgcttcctgtttctgaatctaattaaacaccatgacatagacatactgtcaacatgaaatttcaagtctttttattaaaaatctaaagttgactgtaaaagtcctcatctgtactctgccaaaaaacaatactcccccagcagatccccctctccgtaggattcaatcactgagtaggtcaggacattttcatccaattccctgattatcccaaggccgcatgaccggaattcatccttaagcgccttcagtatgaacctgtctttataagaatcaggaaacatgcgtctgttattggccagtgtcctgctgcctttttttatataagtaaaaatacctgcggcgcgggttcctttatggacaaatggcagcatggcacgctcaagggatggcaggttaaagccctggacaacctccgtatggaaataatccagcacaatatccaccactcctttccttaaaggataggacagggtgctgtccacaagataaaggattttgtggtttttgtccatggcttctatcatgtccttaatatcccgtatcactgacagatccgaatccgcgatgatatataatgcatccggatccaggtataggattcccgtgctcaggaagcagattgtgtttacaaaattttccaatactactttatttttcaggggctggtcctgaatctgtttcaggatccagtaaaaattcttctgcagctggctgaccccatccggtttcagacgcccgtaggtttccctgttcctgtctattggtacaatcctcagtccgtcttcctgttccccgccaatgtaaatgccgccgcatatcccggcatgataaccgcagctgcatgatacatgggcgctttccagctccagttccgcaatcctggcatcttcatatgtaaacgtcccaccacaccgcgggcagcagagcagggacagcatttccagggggattcccctttttctatgccccatcccctgttccagctcatcgaactgctgtttcagcgcatggcacgcctgggcaatgcgctgttcctcctggcagatgcgcctgtgcacctgcctgagaagagtcagtttacgatgttttttctcctgcagctccataccgtcatcccgttcccatgcaagccactccccaacctcctgcagaaggaatccatctcctttaagttccaggatttccttaagctccaggctggatgcctggtcaaaatacagctgtccgtccattttaccgggatgcagaaggcccagctggatataataacgcacggtcctcactgaaatccggttctccctggcaaattcatgaattttcatgcccatacctccataggttcagggttccggggcagaagatgtctccaactcccctatccgccgctcaatccgcagtcttctggtttcccaaaccttcctctcatcctccagctccccaagacggttctgtacgtaccgctgcaacagccggctgtcctctgggcttgcaaaattagacagccggcgcagggataatatctggtgtatttcttttaatgaaaatccggctgattttgacttttcaatcagccgcatatcggcttcgcaatcctcattaaaataatattgccggttccttacttcgggaaccagaaggcccagctctgcatagtaccgtaccgtgtgctgcggcaattggaacttacgcgaaaattctcctattttcatataatccttcccccattaagaaaaaccgatgacctcttaaagatcaccggttccgcttcccttctatgtataatcatcgtatcaacatacaatcatcataccaaagcgctttcctggctgcgaagcttgaccaccgcggacaggtctgtcttcttatgttccttctctccctggtccaggcaattcttggcctgttcctttaccgtctcacacttctgataaaaatatttgatgatatctttcctggtaatgattcctataaaacacttctgatcgtccagaaccggtacaaagttctggttcagggcctttccgatcagatcctccatatctgcgtccgccttgaccggacggttgtcacaccggcggcggattgcggtcactggtatccgctctgcccctttcaaatccagattgaactggttcttaatcccccataacaggtccccctcggtcagcgtgcccacataacgtcctgtcctgctgacaattggtacggcggaatacttatggtgttccatcttctccaaagcctgtcttaacgtatcatcttcacttatatacgccacgtcacttttaggagtcaggaaaaataatatattcatattttcactccttcttcctgtattctctttccagtataatgggtgcctctgaaccgaatatgaacaaattattataaaactctgaaatttcttaagaagcaccaaaactatatctggtatttttggcatattatgtgaagggcaagtgatacaaagctaaaaccttgatttctcataattatatggaatgcttgtccccaccaccacatcctcgattttttcgagtataagccagtcatccatattcccctggtggtcaaaggcaagaggagtgatttcccctgcatcttttaactcaaccaggcatagacatttcttgtgccatcgtgttttctgtttctcagtcaggttcaatttgggctgattctcctcaaggatttccgtgatttcctcttcagataattttacatggttctgtacagccttcactaccgcggacgccgtaatccaggaacttcccttctcaatgaaataaaggcgttccccctcaaaaacccggctgtggggtattttccttcccgctgccccgcgcacaatcattgtctttgtaccggacaatatcttatccaataccctttcacccttcttgcctgcattatcacaataaaccaaatgtaccattttcatttcctcctgtcaccggtatccatatctgactcaggtaatcctcaccatacggattcccgtcactgtaccattccagttccgggcatggcgcgtggcggaagggatatcttaccagccattccccgttaaggtatttccagccctcctggattgcctggggcaccgggcccctgcagtcaaaaacagcccatgtctgttccggcagttcccgtccggtcagccccgggggaaggcttttgtctgatatgaccataatcgaatattctatttcatccatgtccccaccgcaaaggctgaacaggccgaacatccccttttgcgcgcccgtgtccagggaacgcaggaccggataggtaccgtccttttggcattcattccagaacccgggtatcttttcataatgttccccatccgcacaggaaacccgtatggttttcccaatgagccggaatccggccttcctctggacctgccatgaaaactgccgtctctgcgcaatctgcaatttaggcatcacgcgcagcttcacctcattttcccgtgcttcctttggggggatgccatgaaactgctggaatgcttttgtaaatgacgtgggcgagttatatccgtacttatagcttatatccacgattttcatgtcggtgcttttcagatcgtatcctgccagcgtaagtttccggaagcggatatattcagcaaaccccatcccattcatataagaaaatactttttgaaaaaagtcaaaggaacagcctgctatccttgatatctcttccctgtcaaccggctcttccctggcctgcagattgtgttccacatggtctatgatgagctgcagtttttcattccattccatggcctgccctcctttcgtttggacgatagatattttaccatgtatcccgacttctttcatctcattttaagtaccggatggatagcatggaacggaaaaataaaaaccggctggtttccctgccggtttcctgctcacacattgtccgctttactgcatataatccagtgggtccactgtcttatcctgatgcttcatctcaaagaatacattgacgccttccacggaataatacttggtaggctctgacacatagccaagggtctgtccctctttcaggtactctccctgggccacgcatacttccttaagctgtccgcaggttgcggtgtactcattgcccaggtccatgacaacatagttgccgatttcctcattgcttcccacttccaggatccttgcattggctggcgctgccaccggcgtgctcacatctgactggataacgattccagggttgcatttgtactggtcaagggtagggaaataaatggtctggtccatgctgtaatccagaagcacattgcctcttaccggccactgcatcctgctggcgtctgaaaagttaagcaccagcgcgtctgccgcatccttgccggcgcctgcttctgctgccaggtcattgccctggttctcgttctttgccacagctgccttggtaggagccggggtaaccttctgtgaatccttgactgcatcggatgcgcctgccacctgggcggtttccggcgtggtttcctgggcaatcatttctggctggggcatttcaaggtatggatttgtctcagtaccttttcctctttgtacggtaatgacacctgctgcggctacaatagtcagcaggcctaacactagcatgacaagaaataacttatccttgagcatctggtttactttctctttcacgtttatcacctcggtactattcttaccaaaccagggcgacttattcagaaatgtaagtaatatttttataaaaataacttaggatatcttctgccttccagccggcctttgccttctcattggcagctgcctggcttaagccgtaaccgtgtccgatgccctttaccaccgcccggatctggtcctcatagctttccattgtaaagcaggcggactggagtcccagggcatactgcacctcttcgccggaatagccggcatttccaatctgtatctggtccacatagcccgccgtgtccctggacacaatctgtatggaatccgggatctgtgacgcgtccactgagcgggcgcctgtttccccttccggaatcccgttgatacgggacacgaattcatctttggaaaatgtggcaatctgcatgtatccctctgcttccacatcccccggacaatccacgttttccaggtaagggtgggtaaaatcccccttcctcgtcatgcctgccgtggcccggcagaacatggggtcaatgcagcggttctcgtaggtcatcacaatgccggaagtggcctttaccgcaccttccagtttcctgtaatactcagggaaacggctggtgccccacaggctttttaactggtccgcctccacatagtccatgtccagggccgactccgctatctcatccatttccccggccgcctccatctggcggcagatgtaggtgcgcgcaatgattgcctgggcctttaacgcctccggctcataatcaaccggtatctgcctggcaatgaccccgggaagatactcctctatgtccatataataagaaccgctgctccggtccagcaggatcctgcgttttcccgatacttccttttgctgttcatagtgcagctcctccccccggatggtgcctgtccatgcaagtgtgcccacataggggaccattagcccggtcagggctgcccataggatgcgtctgttcatgcactccctccctcctttccctgaatgcggctgaaaaatccctctgtcatcaatatatgtccgggacgggcgccctatgtgccgccttttggcgcataaaaaaatatcgccgcaccgggccgggccggcgggcgatatttaggatattatatgatttcctgggcgccatggggccgggtcacttcaaatcataaatcctggtatatttttccttcagataccgcacataatattccgggttaaagtcctcccctgtcacatcctttaatatctggcggctggtctttaattttccatactggtggatattttccctcaggtactcacggatggcgtcaataccgccgtccgccagaagtccctcgaagtccatggtcttcttcatatgataatacagctgtgccccaaaggcgctgcccagggcataggacgggaaatacccgaaggaaccctgggaccagtggatgtcctggagcacgccctctgccgggttctcagggcgtatgcccagatattcctcatatttatccgcccagataccgggcagcttctccacatccaggtcctcctcaatgagcattttctcaatctcataccggatcagcacatgaaggctgtagctcagttcatccgcctcggtgcggataaggcccggggttactttattgatggcctccacgaactggtccaggtccacctgtgccagctgactggggaacatttcctgcacctttttatagatgggcacccagaatgcacggttgcggccaatgatattctcaaagaaccgggactgtgactcatgcattcccatgctggccccctgtccggccggggtaagggttaaatcatcccggattcccagctcatagatgccgtgcccggcttcatggatgacggaaaacagggaactgtccacgcagtccgtgtagtgggtggtgatacgcacatccttattgtgcaggttggttgtaaagggatgggcgctgaccgccatgacaccgcggtcaaaatcaaagcccacataccctgccaggaaacgccccagctcctcctgcttttcctcaggataattccctttcaggaagccgtcctcaatctttttgccttcctccattaccttcttgaggaatggcaccagttcctttttcaggacgccgaagaactcatccaggttctccatggagaatcccttctcataatcatccagcatgacatcatagagctttttcccatcctttgcccggtaacccgcaaactttttctggaaccggatgaccttttcaagggttggggcaaatgcctcaaagtcctggtctttcttggccttggcccacacgctggtggccctggcggtcaggcgggcaaactcctgatactcctcctgggggatgcacatggtctgctccagctcctctgtcagttccctcacattggctgcctctgcctctgacagtccgccctgctcacggcactcctttaaaagcttcctcatcccatcgcaggtcactgcctcaaaatattcgcctgacagcacaccgatgacctggcttgtcagttcccctgcctcctttggggcaagcgtctcattgtcccactcaaataaggtcatggctgtcttgatggccatggctttgtccatgtatggttttaattcttcgtacggctttgacattttctctccttcctgcccgactgtccatgatacagaaacagtaacaggtcctggaaacgtggctgaaacgcgctcccatccatatgattccctgtcattatacatcaatatacatgcgcaccgcaaattttatctgtaaaaaaataccgctatgattcttactttttttcatatcaacgcattaaagtgcttgcgccattgctttcaatatagtactatatattctatagaatataaaataaaccggagacccatccatgatagaagatttaaaagcagtcggcaagaccccgctcagtgaaaaagtatacagcaccctggtggaatccattgtaaaaggcacccttccccccgggaccaaactccaggaacagcacgtggccaaacagctggctgtcagcgccacgccggtgcgggaggcattccggcgcatggagcgggatggtttcattgaaagcatcccctactgcggcgtcgtggtgaaggagctggactatgaggaaatcatggatgcctatgcatgccgggccaacctggagctcatggctgtccgggaagccgtacataagattacggaccagcagttagaccttctggtccatctgtcccacagcgctgccagcgaagatgatttcatgaagacttcggaaaacagcagccgtttccatcagaccatctaccaggcagcgggcaataaggtcctgatccatctgatggattccctcagcaccgtcatcctgcgggatatgaagtattcggccatggatcccaagcgcgaacaggagatactgtccgaacacaagcgcatcgtccaggcattccttgactgcgatgaagaaaaggcggtcagggccatgtccgtccatctggacaacgggcttgcctatatgaaaaagagaaggtaactcttctttttttaccccgatatattctatagaatatttaatattgaatatctgtcctgaaatcaacatcaggcaggaacatatataataccattggaatggaggtaacagaatgaagaaaatactgatggcccgaggggccgacaaggtggtatccacctgtgtcaaagtaaaaccgggcgagaaggtgctgatcatcacggaagcttcccgcctgtccattgcggaggccattgccgcagccgtataccgggtccaggcagagcctatcctgcaggtcatggtcccccgtgacacggacggacaggagccgccggctcccattgcggctgccatgaaggccagcgacgcgtttatttccgtggtgggcaggtccatcacccacacccacgctgtaaaggacgccattgcagccggttcccgcggcgtggtgctgacccagttcaccgaggacatgatgatacacggaggaattgaagctgatttcgaagcagccaaaacagaatgcaaagccgtggcagccgcgctggcaggctcagaggaaatccatctgaccaccgccatgggaaccgacctttactacagtgccgcaggaaggcgcggcaacgccctttactgcatggtggacaagggtgagttctcaaccatacccacggtggaggccaatgtctcgcctctggaaggcactgccaacggcgtcatcgtggcggacggaagtattccatacataggaatcggcgtcctggacgagccggtgcgctgcatcgttgaaaacgggatgattgtctccatcgaaggcggccgccaggccaggatgttaaaggcggacctggacagcaaacaggaccccaatgtctataatgtggctgagatgggccttgggctgaacccaaactgccgcttcatgggcttcatgctggaggatgaaggcgtctacggcaccgcccacatcggcatcggcaccagcatcacactgggcggcacggtcaaggctgcctgccactatgacctgatcatgaaggacgcaaccgtaactgctgacggaaaaaccattttaaaagacggaaaagtcgtactgtaaggaggatatgatatatgacaaaagaaaaaaccaggaataagtccctgttcaaccgtttcttggacgtagtggaacgggcaggcaacaagctcccccatccaatcgttctgttcggcctcttcgccctgggcgtggtggtcatctccgggctgcttcacgccatgggcgtttccgcggaaggcgaattaatcaacagcaaaaccggggaagtggaacacaccatcgtcacgatcaaaagcctgttcaacaccagcggcattgtctacatgatgaccaatgcggttaagaacttcaccggcttcgcgccgctgggcaccgtgctggtggccatgctgggcgtgggcgtggcggagcagagcggctggatatcctccctgctgcgaaagaccgtggaaatcacaccggcagccctcatcacaccggtggtggtattcttaggatgtatgtccaatgtggcgggggacgcgggctatgtggtgctgattcccatcggcgccctgatgttcatggcttacggccgtcaccccatggccgggctggcagccgcctttgcaggtgtttccggcggattctcggctaacctgctggtaggcaccctggatcccctgctctcaggaatcaccaatgaggccatccgcatcgtggatgccaattacacggtacagcccacaggcaactggttcttcatgtgcgcctccacctttgtcatcaccatacttggcaccatcataacagataaaatcgtggaaccacgcctggggaaatttgaaggcgggacagatactgccggtttcacctccagctccatgtcacaggaagagagcaaggccctcaagacagccaacatcgtactggtggtcatggtcgtcggaatgattgcgctgctcatcccccagtcctccttcctgcgcaaccccgagacaggaagcctggtggacggctctcccttcatggacagcatcatcatactgatcgcgctctactttttcgttcccgccgttgtttacggcaggaaggccgggacctttaaggaccaccgggacgtatgcggctccatgagcaagagcatggcttccatgagcacctatatctcactggtattcgtgtcatcccagttcatcaactattttaaatacaccaacatcggcaccatcatcgcactgaagggcgccaacttcttcggcgcatcgggaatcgggccaataccgctaatcatcctgtttgtcatcttctccgcatttgccaacctgttcatgggttctgcctctgcgaagtggaccatcctggcgccagtgttcattcccatgttcatgctccttggcttctcaccggagctgacccaggtggcgtaccgtatcggcgattcatgtaccaacgtcatcaccccgcttatgtcccagttcgcaaccatcatcattttcgcaaaacgctacgacgacaatgcgggaatcggaaccctggtggcaaccatgcttccatacagcctgatcttcctcatcggatggaccatcctcctggcattatggatggccttcggccttccgctcggccccggcgtttcactgatgctgtaggaaagaggaatacacatggtcaaccggaatcgattactggaaacattcatggaatatgtcaggattgacagtgaatcaggagatgaaagggaaatatgcctgaaggtggaacaggacctgaaggccctgggcgcggacgtgatacggcagggaaatgcacaggacacccattccaatggctggaacctgctgtgcaccctgaagggcagtcctggccttcctcccctgatcctctcagcgcacctggataccgtatctcccggaaagggaatcgaaccagtccttggacaggacggcgtcctgcgcagcaaaggccccaccatccttggcggggacgacaaatgcggggtagcggccatggtggaactggcccggtccttaaaggaccatccggttccccaccgcacggtccagcttatcttcacagtgggggaggaaagcggacagtacggggcaaaggccctggaaaaagaccgttccctcctggaaacgggtaatgccctggtgctggactccagcggtcccccagggcgcatggtcatctccgccccgggccacgccgtagtccgggccgtgattaccggcaaggcttcccatgcaggcaaccgccccctggaaggaatcagcgccatcaccacggctgcccgggccgtggctgccatgaagctggggaaggtggatgaggaaaccactgccaatatcggaacactcagcgccgtgggtgccaccaatgtggtgaacccccgcacggaattcattgccgaggccagaagccggaacaaggaaaagctcaagacccagacagaccatatgacggactgcctgaaggctgcctgccatgaatccggcgcggcgctggattatgaaattgaacatttatatgaagggttcgatatcccggaggaccatcccttcttattggagctgtcagggatattccgctccatgggcatttccccctttaccgcctcctccggcgggggcagtgatgccaacgcactgaacgccatgggaatcatggccgtgaacctgggcgtggggatgaccagggggcactcaacggaggaggagctggcagagacagacctgtatgatacggcgcggtttctgtgggaggcagccatatttcacgggaacgactcttgccggggctgagccacatttcccagacactcccgcgcccgggctaagccacattcccaggcaagtcccgccctgccagtccggccatcacgcggcgctgtaagccgcaatcccgataaagaacaccacggtcatcagcgtacccacggagagggtggtggatatataggccccatcctcccccgtgtccgcaaacagcggtatgataaagggcgcgggcagggcgtacatcagcagcattgccatgaaaagctccttatcaaagggagttaccgtaaatatgacggcgctgcccgccgccaataccgctgccagcactgccaggcggagcaagaccgtcttcaccaccggggccatcagctcccgtctaagttccagctcatatcccaccacaatcaggatcacgcccgcggtgggcgccgtgatgaagccaatgaggcttgtcacgattcctcccatctgcgagccaaggatcacgcttccggctcccgacacccccagtatgatgcctgccgccatgcccaggcacgccttattggacacaaggctggcaaccacgtcccgcgcccctgtcttctgcccgtccgtaatcttaagggccgacaggtacaccgtgtacgcaaacacggtctggccgatatcaaccgtcgcaaacacggaggttgcgccgctgcccccaatcagggcaaagagcgcgtatcccagcatcccgccctctgccgaactgagcaggaagggcatgaaacggtcatatggcttcacaaaccgcctggtcaggaaaccaaatcccagggcaatgccaaatcccgcatagaccaccgcaaacacaagcagcaccctcatactgtaggaggctgtcagaaatgcattgaaaagcaccaccggcagggtgatgttcccaatcaggcccttcagtccggccagccccttgtcatcaatatactgttttttcctgcacaggcatcccaggccaatcatggcaatcacgggcgccaccatctgggctatttttaaagccagttccattttccatccccccattttcctaaaatcctgaaacaaaaggcaggccaacaacgcagcctgccttttttaaccagcggatccgaatccttttcatgtctcagggcaccttccaaccgcgccccagccatcctttagtggattgcatcctcaaagaattcatatgcttccttatccgtaaatccttcatgcacaatcttgccgatggctgccgccatctccagggaatgggtgctctggaagatgttccttcccatatccacaccgcgcgcccctccgctgattgcgttgtaggccagggtcagggcttccttctccggaagcttcttgccgcctgccactacaatgggtaccgggcaggccgccactatctcttcaaagttctcacagtaataggtcttgatgatattggcgcccatctctgcaacaatacgggtagccagcttaaagaaccggtccgtgcgctccatctgtttgccaacagccacaacgcccatggtcgggatgctgtatctcattcccaggttgattgccttagaaaggttctcaatgctggacagctgtccgtccgcgccgataaaggtctggatggccatacagtctgcattcatgcggattgcgtcttcgatgtcaacagccaggatctcatgggataaatcatcgttgagcatggaggaaccggaagtggaacgcagggcaatgcccttgccgcagtccggtgacacgcaggagcgcagtgcccccctggtgcccatcagcacatccacgtaaggaaccagcttgggaatcaccaggtccagacgctccaggcccgcggtcgaccccatgaaatatccatggtcaaatgcaaacattaccgtattgccgcttttggggttaaaaatgttggacagatgtttcttcatgccccagtccagatgattggcccccttcacatagaatccttcattattggcaaaaggaacgtccacgtgataatcctttgcaacctttacgccttccaaatcagccataatcaaaaatctccttccaagtcttttcttacagtttaatcaattttgtcctatttttcaacttagaagttataatcgttcatgttgtctgcgttgaatacggtacgctcaggcagcagcacaacgccgttgttgacttctgctgtggatgcgccttcaaccaggcagtcatttggcataacttctacttcaccgatgctggggatatcaatcttgtcgcctacatgtacttcgttgcctgctgcaaggtaagctgcaaggtagcatcccattgcgccctgtacgccgcagtcccaaaggccccactgctcaataacgccagctgcgcagtaatccttgatggacattggggaagcaaaaccggtaattgtaacgtcatcctttgtaaggcccttgttctgggcagctttacactgtccgggaagcgcggtggagtcgttacagatgatcaggtcaatatcagagtgtgcttccaggatggatgcgccgatggaaacagccttctctgcatcctgctctgagtaatagttatcaggagctacattttcccagttggggaagttttccttgatgtaggcttcgcctgcaacctgccaggagttctggtcagcaaccgttgcctgtgaataatgccagcagtacttaattgtatcagcctttacgtccttgccgcggttagttaaggaatcagcgcccatgtcaaccagcatcttgcctaacaggtccggtgttccctggcttaccatcagggtacgggccgtatcggaaacgtctgaatcccatgtaacaacggttacgcctgcatcctttgcctctgtcagggctgaatccagtccggtggcatccacggaagatacacagattgcatccacgccgctggcaattgcgttgttgattacatttacctggtctgcaaccgccgcattggcgctgccctggtaatcaacggtaaagccccactccttggagtattcctgggcgccgttattagcggactcgaagaatgcattgccggtcagcttggggatgaatgcaacggtcaggccggatacgtccgcgcctgccgccggagcctcagctgcagtctcttcctttttctcttccgcctttgtctcagctgcctctgcctttgtctcagccgctgttgtgggcgctgccgttgtaggggtgcttccaccgccgccgcagcctgccagcgaaacggtcattgctcctgcgagaaccactgataacaattttttcttcataatcttgttcctccttaataaattattatagtttttttgcatgttcgtatttacagggaaatcctgttcccataatacctttttattttttctttttatggaccagcgcgatgatcttctggttattcaccagggagcgtccgatgaccacaacaagcaggatcaggcccaccgggatatccagatactgctggcttaccttaaagcagaggggaagcccgaaccttaagacgccgatgaccaccgctgccagggctgttccaaggacgcttcccttgccgcccgtgctcagggttcctcccagcaccaccgccgtgatgatgggcatggtcagggttgcgccgatgtcactcttggccgttcccagataggaggtcaggacaatgcctgcgaccgccgcgctcatggcggacagcacataggtgctgaggatgaccagcctgctgttgatgcctgaatactcggctgcattctggttcacgccgatgaggaagatctgccgtccgtacttggtcttatgaagcaatatgtaagcaatgacggccagggccaggaaaatgagcacctggttgggtatgacgccgaacagcttaaacttggtaatccttataaagctgtcaggaaacccgttaatgcctttgtagctttccgtggctgacaggttggataccagcagcgcaaggcctgagaacaggaagctgccacccagcgtcaccaccatgggctggaccccgcagtaggccacgaagtatccggaaagggcgccgcacagcgctgccaccacgattccaagaagggctgccgcccagatgttaagtccccagtcctgccaggacacgcccaggacaatggaggtcaggcccacaatggaaccggcctgtatatcgattcctcctgtaatcattacaaaggtaacgaacagggaaatgatacagatggaaatcatatcgttgatgctcccgaacaacacccggggcatcaggaacttgctgttagctgttgcgaatatgatgaactcaaggaccaggatacagagcaggacggtctcccagcttttaaatgcctttttcatgactgaacccctccttttttatcagcatccgccgctgtccttgctgacagtatgtggtgccggttcttcaggatggccctgttctgcgttacggtattgatgaccacgatggtaatcagcaggatgcctgtaatggtattgtcgtaatcagaggagaagcccaggaatacaaggatcctgctgatactggacatgatgatggcgccgatggacgcgccgatcaggcttccctgtcctcctgtcagtgcaatgcctcccaggacacaggccgcgattgccttcatctcatagctgttgcccgcggtgggcgttatgaagccgatccgggaggtgtaaatcatgcctgccgcggcagcaaatataccgctcagtatgtaagccatgattttggtctgggttgcgggtatgcctacaagggtggcgcctgccgcgttgtcccccacggcaatgaagtatttgcccttcttggtctgtgtcagtatcagatggcctgcaaccacaatcaggatggtcaccgcgtaaaaggtggtgagctgcccggctatcagggtattggacatccttgtatactcggcgggaaggttctccacccacgccccctttgtatacacataaatcagtccgcgcaccacaccgttgacgccaagggtaaatataagggatgggatctgaagcacggaaaccccaaatccattgacaaatcctatcactgccccgatggccagcgccgccagtatggctgccagccagttggatccgtccctcagcagggttgcccccactgcggcggacatgcccagggtagcgcccaccgatacatcaatctcacccgtaaggatgacaaaggcgctgcccactgccagcaatgtaaacaccacgctgtcgttaaagcagtttaagatggatgtgggctgccagaaagccgggtttacacatcccacaatgaatatcaatgctgccagaaatagaaaactgctcatttcatgggatttgattatctttttcatttgattcatgtctctccacctgctttcattcttctgccacaccaaaggatgctgccatcaggctggcctggctgatttccgccttggacagttctcccttgatacgcccggaaaataccaccactgcccggtcggaaagctccacgatttcttccatatcagaagatatcagcatgattgctacgccctgggccttcagtttatgaataatggaatacacatcgcccctggccgcggcgtcaatgccacgggtaggctcatccagtatgaccagcttggggttggtggaaagtgaccttccgataacgattttctgctggtttcctccggaaaggcttccggccgtctggtcctggcccgtaaccttgatacggaaatcatcgatgtagcgctgggcaacctccctttccgctttccggtccaggaaaaacccgcccatcttcttatccattaataaggaagacgttgtgttggctgccacgtcgctgatgccgaacaggccgttcagccgcctgtcctcaggcacgtaattgatgcctgccttcagcacctctgccgtggaaagaccggttacatccttaccgtccaggattgcctttccttttaagaccttatcccttccgaatatggtggtggccagctccgtacgtccggcgcccaccactccggccactcccagtacctcgccggggtataccttcaggttcacgtcctcgaatccgtatccggaataatgctgcagttcaaacaccggcttcaggccttcatagtgaatggccccggccgcgtccttgccgtcctttaattcagattcatccatattgggaggaaggagtccctttaccagcatctccctggaaaaatcagcaacgcgtccttttaatgtaatgataccgtccctcatgattgccacatgggttgctatctggaacacctccgccagacggtgggttatgtagatgatcccaatgcccttcttctttaaatcctccactatcttaaaaaggctttccacttcgtcaaatgtcagggcgctggtaggttcatccagaatcaatacccttgcgttccttaaaagccccctcagcagctcaaccagctgctgctctgcgatggaaaggctcatggccttcctggtcaggtccaggtgccagccaatgtcatccatgatctggatcagccgcttccttaagggacctgtcttttccttgaaaccgatcagcacgttctcctcaaccgtcatgttgggaaaaagcatgggttcctggggtaccatgtagaccccttttgcaagtatgaccgaaggtttgaaggtacttatcttcccgcctgcaatcacaagctccccttcgtcaggctggtagatacccatgatgatcttcatcagggtgctctttccagcaccgttcccacctatcaaagccagcacctcgcccttaccaacatccaggtcaattccttttaaaactgcgtttaagccaaatgtcttaaagacgccgcgggcagaaagcagcatgtcttttgaatcacatgttcctgcttgactcatgtttaccctccttagcgcatctgtatttatcgtttttgatatttttgtttgttaataaaacatttgtaacacttgtaagtatacgggaatgacataagtttgtcaaggggttttcagcattttaacatgatttacgcgaatccgcacagaccatttttagtggtttgtaccttttacttttctgttttgccttattttttcacgaattagtgcgcatttattaaggttcattcccctatttcatgtgtatttcccccaattttgcatattgacattaatgttgccctttgatatactaatgtcaaagtaaacattttatttgaatcaaaacatttgtttcacgtcttttctattgtttggcttcatatgttttgcttcataatataaatcatgttacaaatcgtgatacaggaggtgttagggccggtatggattatgaagattccttaatcgttaaaacagcctggtactattatatagaaaacatgacccagcagaagatttccgagaagctggggatatcccgcatgaaggtcatcaagctgctggaaaaggccagacagacaggggtgattcagtttaagatttctcctgagcggagccagcagctgatgctcgaacagaaactcaccacccagtggaacttaaaggatgtctttgtggtccccaccccgccgaacggctccaacctcaacgagaccattgcccaggcagccgccatgtatatcggagacaggctgacggagaacatgttcatcaacatgggatacggggacacccccagcagggtgctgaaccatctggccaccatagccgaatcccccatctccgtggtttccctcacaggcggggtcagctattacctgcccaatatccgttccaacatcttcaatgccaagctttacctgtaccccgccccccttcttgtatcctcaaaggagatgtgcaaggccatgcgtgacgagccgcccatccaggagattgcaaggatggtccgcctggccaccatgaccgtggtgggaatcggggccatgaacgaggatgcaaccattatctccaacggtatcttgaatcccaatgacttcctgtacctttccatgcagggagcggtcggcgatatactgacccacttttttgacaaggatggcagccctatccacagcgacatcgaggaacggctgttcagcacctcgttgaatacattgaagagcctgaataatgtaatcggcatatccggcggtcctcagaaggtggatgccatacgcgccgccctcaggggcagttatctggatgttttaatcacggatgaggacactgcgatgcagctgattgatttagattaaaggagaaatcaaaaaggaggagttacatatgtcaaagaaatactttcttgctgttgatgccggtacaggcagcgtccgggcggtcctgttcgatctggacggcaaccaggccgcatgtgtgcaacaggaatgggagcacaaagaagaccccagatatccgggcagcatggattttgactggacatacaactgggaactgacctgcggatgcatccggggcgtactgaaggaatcaggaatcgcgccggaagagattgcagccgtctccaccacctgtatgagggaggggattgtactctacgacggatcgggcagggaaatctgggcctgcgccaacgtggatgccagaagcgatgatgaagtgggccgcctgcgccaggcctatcccggccaggaaaaggaactgtatctggagtccggacagacctatgccctggacgccctgccacgtcttctgtgggtcaaggacaagatgccggaagtatacgaaaagctggcctatgtgggcatgtttaatgactggctcatctataagatgaccggggtcctggccgtggaacccagcaacggttccaccaccggcctgttcagcctcaagaagagggactgggatcctaccattgcagagcgctgcggactgcgcaccgacattttccccgaggtacgcgagtgcggctccaccgccgggaccgtgacagcccagtgtgaggcccagacaggactggcccagggcacgcccgtgattgtgggcggcggcgacgcccagttaggctgcatcggcgtaggggtggtgaagccaaaccaggcagctgtctttggcggcagcttctggcagtatgagtacaacacaggggacggccagaccgaccaggactgccgtgtccgcgtcaactgccacgccgtaccgggcgtatggcagtacgaggcccttgcatttaaacccggccttgtgatgcgatggttccgggacggcttctgccaggccgagaaggagctggcaaagcttgagggcacggacccttacgatgtgatgaaccggtatgccaaggatataccggccggatgctacggcatgatgtgtacattttccgatgtcatgaacttcatcagctggaagcatgcttcgcccacctttaccaactttgaactggacccggtgcgcttctccaagtacacgttctaccgcgccatccttgagaacacagccctggtcaccaagggccatctggacctggtccgggaggccactggcaaccagcctgaggaaatcattttcgcaggaggcgcttccaagagcccgctgtggtgccagatactgtccgatgtgctgggacttcccgtgaaggtcccggttgtcaaagaggcaacggccctgggtgccgccatcctggcaggctatggggtagggatatacgacgacatgtcagaggcagccgggaagctggtgaaatgggacaccacctatgtccctgatatggagaagcataagatttactgtgaaatgtatgaacaatggcgcaaggtttacaaggctcagctggatatctgcaaccaggatctgaccaagagcatgtgggctgccccaggattatagaataggaggacatattaagatgtttattgtaaatgagagtgagaaagaataccgcttcggcaacagcggccccaaatacctgatgaaaggcccgaggatgaattttgcagtggtgcagttccagccaggggaggattttaaggcgcattaccacaatatcatggaggagaacttctttgtcctggaaggagaaatcgacattgtggttgacgggaccgtgcatcatttaaaacaaggggatctgatccatatagaaccttctgaaatccactactgcgtcaactcttatgataagacagtgaagatgatatccacattggctccttatcaggaagtggataaggtggagattgaggattatacttattgatgggataccgtttggggaagggtccggccgtggatatggccgggccctttttccgccaaaaaaagcgtaaataaaatgcccaccctgtctggtccacagggtgggcggcgtccgtaaggatatttagaatactcatcctgattcctaccgcccatatcctgaacagtaagaccttaccctctaatcaaaaagagcgaaacctgaggcacaaacgctatgatgactaccgcgatgaacgccgcaatcaaaaacggccagacacctttcaccacatctgaaaaagttgtatctgctgtcgatgccgcggtaaacaggttcagcccaaagggaggcgttatgaagccgactaccagacacacacagaacaccgcgcccaggtgaaccggatcaatccccaaccgcactccgataggaaccaaaatcgggccaaggataacgatgctggatagtgtctccataatacatccaaccagaaagaggatcagcatcaatataatcagatacgatacacggttattcaaatacggaattacagcattggcgattttaaccggtatcttagcaaccgccaatgtccatccaaaacaattagacagtcccacgatgaaaaccaccatggccgaggtctgtatggtcttcatcattgcctccttaaagcgctgcaatgacaattcccggtacaggacacctaatatcaaactgtaaatcacgcacaccgtggcggcttccgtaggggtaaaaaatcctccatagatgcctcccagtattatgaccggcagaagaagcacgccaagcgctttccatatggaccgtaatacctcttttgtggtatatacagccttttccggcttaatcccgcctcttacggcaataatcgtgttagtaatgatgaacagtaccgccatcagtattcccggaagtatcccagccataaacagctttgggacagaaacactcatggtacatccatatacaataatcgggatgctgggcggtatgatcggccccagagcgccgcctgccgccagtaatccggaggcagtggtcctggagtatccagccttcatcatagtaggaatcatcaatgcaccgatggccgccacggttgccggacccgaaccagttaatgccgcaaacagggtacagcagataatggttatggtccccatgcttcccggtatccagccaaacatcttttcaacacaatctatcagccgtttcgacagccccccggactccataaggtaacccgaaagtgtaaatagaggaattgccagcaacacaaagctgtccatccccaaaacacttctctgtgacaggattaccagcggtttcatgtgtgtaaccgtaagaaacacagcagttgacagaccaatagaataagcgatagggactccaaataaaataagtacaaacaacgtgataaatataattccaaattccatgccatcagccctccctatccatattcattttggcctcgcatatatttctgaccgcattcacaatcatgcctattccccctacagggacagacgcataaatatatcccatgggaatacgcagcgtaggacttggctgtgtcatggtataaccgatcatgcgcatcccctcgataatcaggatcaaagcaagaagaatcatcagtccatgaatcacgatttcatgaatatacttctttttaccctttaatctgttgttgagtattgataccacggcatggcttccgtatctcacgcagatactggctcccagcatattcatccatacaaaacagtatcttgcaaattcctccgtaccagtcatagacgcattcagcacatatctggtaacaacctgaagtgtcgatgccacaatgattcctgccagcagaacgactgcagccgactggtatattttattcatacaatcatctatcttcattatcctgtccatcatttcacctcccgccatcatcttcccagtttccggaaaaccatatccacatattccgccccaatggtatcacggtatgttttatagacaggctctgaggcttgtataaaccctgtcttatcttccacggaattgacaacgactcccatatcttccattttcccgataaaatccgtctcaatttcttttacaaattcccgctgtctccttccagcttcaactgccgcggtctggaaccacgttttttcctcctctgacaggctctcccatgtctgcctggaaataacaattgctgccggggaataaaaatgctctgtaagcgacagatacgaacagacttccccataccctgtggcatagaaggaggagatgggaagctccaggccgtcaaccgtcctctgctgtaccgctgtatatgtctcactgaacgccatagtagtagggttacttgcaaaagctttaaatgcatccaaatagatggctgtttccggaaggcgtattttcatccccttcaagtccccttctgactcaattggctttatattgttcatgacgctcctgaagccgccctctccccatgcaaggaatttcacatcacaatcgtcatagagtttctgtttcggtccctccatcacggtttcatcatcaagaatacgatatgcctcgtcacgggatgtaaataaaaacggcaggtcaaatgtctggaattccggcacaaaggacccaaaactgaagttggtaattaaggccgcatccaccgtccccattttcataccctcaatcatatcccgctcaccgcccaaaatggaatcggtcaggatatccaccgcaaaccttccgcccgatgcctttgccaactcctcaccgaaataaacagccagtacctgatactggtcatccgccttcgcactgtttacatgaccaatctgaatcacctttgccccgtccgtatccgtcatgaatttcttctgcccggtgctgcagcccgataaaaccgctgccgcacaaatcatgctgattcctgctaacaatcccctatgcatccatgcatcctcctctaaataaaatcatactgcctgtgcaggataacaccctccttaaccgtcaattcaggctttatcatctgcaatccgtatgccgtattgccatagctgtccttcatctcaacattcctatcctctatcctgaatatagcgatgtctgccggagcatcaatccccaatcctcccatctgtggttccttcatcagcttagcaggtactaccgtgcaccgtctgatgatttcaggaaaccccatccccagattcaacagttccgtcatgatatgggtaaacgaatatgcagggaaccggttcatggataaaagacttaaatcagagcttacaatatcagggtagaatccctcaccgattgcctgccttgccacttttatggaaaagttccggcttccatgccccagttcaaagagaatcccccgcttcctggcctcccacacagccggcagcaccttttcatcattccccagaaccgtcttccccttttcatggaatacatggcaatatatatctcccggacgcagcatcccaagcgtatccgctgtctcccccggagaatccgtggcatgaacagaaatccttaaccctacttcttctgctacttttattgttttttccaagcacttaagcccgtatccgccaacaatatccttcccctgcctcagcttaatccctatgatattatccctgtacttatggcataattccctcatccgatccacatcgaaaagatcaggattacagttttcattaaaccgatgtgtcatttggccaagactggtgatatgaatgaagcttttcattgtcaaaatactcctacacacaacatcccggtaaaagccttcaaaatttgaggttcccgccgaacctgcatccaccatggccgtcaccccatgaggaatcagagccaattccgccggcatggaaaaatcgcttatcccataaaatgcatgggcatggaaatcaatgaggcccggaaccacatagcatcccgatgcatcaatggattgcgcacattggtattctgacaggtttccggccgctgctatggcacggcctttaatcccaatatccattacctggtcgatatcattcttaatatccagcacatgcccgttccgtataatcgtatccagcatatccctttcctttcacgtctttttattttgataactttatgttattcttttcacaatttacaattgtatcattcaatctatatcttagaaaaacatttttaattgtatcatatcccccctcatctattgtcattatttcttatttcagcagttattttttaaatattttgtttatattttcatattagtacattcaggccttgaagtccaatgacaattacgatatactaattataactttttttcatatttataggagggtgaaatgattaagaactttgaatattttctgatgatagtcgaagaaggcagcctgtcaaaggcagcagaaaagctatatgtatcacaaccagccctcagtaaatacctgaaacgtctggaggatgagaccggaatagaactctttaatcattcccgctcccctctttcccttacctatgccggagaacaatacttaaaatacatatccgaggtagaccggttggacaaacagatgataaaagaattatcagagctaaagaccaataagagagggcgtctcaaaatcgggctggcgttatggcgcagttcctgtatcctgccggagatactgcctattttcaacacccggtatccagatatcgaattaacgctcatggaaggcaactcggaatatctggtaagcaacctgcttaaaaaccgtatggacgtctgtatcatgaatccaattgccactttagattacagcaatcttgattatgaaatcatcatggaggaaaaaatctatcttgccgccaaccggaaccatcatctggtttccagatacagccatgataccgtatccgatcccccgtattttgatgtccgcctaatcgagaacgagaggctgttcctcacaaagccaggccagaacctgacacgtatcctctcctccatgttcagcaagaaccggatgagcccggccaaagtcctggagaccgccaatctgaccacggccatcaacctggtctctgccggtctgggatttaccttcatccctgaagcaggaaccaaatctgatttactgcctcccaacatcatgcttttcaccatagaccagccggctttaacctggccgttagctgtctttttcaagaaaggagcctacatcacaccaacctgtcagaactttatcaatacgttaaaagaggtctatgccattccatccagcagataggctgttccggctcctgaatatgctacaggatttccttcatgcaatccacaagaagcctggcctgtctcctaagcggcaaactgttcctatatgccacccccacctcccacctaaggggcgggtcatcgatggagaagaaatacagaccatcgttctgtccccgtatagaaagaactgcttccggaacaaacgtgacgcctatcccaattttgaccatattcattgccgtcacgatattagatgtctccagaaggacattgggatgaattcccagcttattcagatagttctgggttatatccctaatattctgtccctgcttgagaaggacaaactcctcctcttcaaacttaaggaattcttcatgcgacagaacattcaccccctcgggattgcctatctccactcctgccagtttcggattatctttgttcacacagaataatatcttctcgaacagcagatgctcaaaggtaaaatcatggtagctgttgggaagatggaaaatagagaaatcaactttgcccagttccaacatagacgccatatgctggtgggagccctcctgtatgcccacatggatccttggataccgtgccctaaaaaccggcagtaccaccggcatcagtatggaggacctccacactgtgattcccatggaaacctctcctgtctcgctgctccgcaaatatgacaactcctccagcagccatttttccctccttgttatctctttcacatgggataagtacagttcccctgcatctgtcagcttaagcggataagaatccctgcagaacaattcctctccaatattctcttccagacgcttcaggtatttgctgagggatggctgggatatgtacagacggcctgctgcttttgaaatgcttccctcttccgctatggccatgaaatactcataatttttaaataccattctctccctccaaaacattattcctaaaagtctatatatttaatagaataacgtatcttagacaaaaagtacagacacgattataattaaatcagatttcagacaggaacctctgcgatggccatcaccgggattagtctttactgaaatactcccatacacataaaatggaggtactctatgtggaatgcagttatcgttgactgtaactacggaagtgtaagcctggaaaatcaggaatacatcaaacatgaatatgaaaaaaacggaataaatctacgccttgcacattatacaaccccccaggaaatcctggataactgcaaggatgcggatgcaatattaggaaccggcaatccgcccatcacaaaggaggtcctggaagggctgccaaagcttaaggttgtacagcgctttggcatcggcgtcaattccattgatttggaggcagccacaaaaaccggcaccctgatactctacatgcccggcttctgcgttcaggaactggcccttcacgcctctgccctgatactgaaccttctgcgcaatgtatcattctatgaccggaatatacgaaatggacaatggcccaaagctcagggatacatcccccgcaaccccaaagatctggtgctgggactttatggttttggcggttccgcccgccccttatatgatatcttctatcacggtttcggcacaaaggtcataacctgcgacccatatgtcaaaaaggatatcaaggaaaactacgatgtggagattgtctactttgatgaacttctggcacgggcggacatcctttccatccacgcccccctaacagctgagacgcgccatatattcaaccgtgaagcatttgtaaaaatgaaaaaagaagccatgatcatcaacatttcccggggcgggctgattgaccaggaagcccttacatgggcccttgatcatggggagatccgttttgccggtctggatgtctttgaacaggaaccgcttcccgcctccaacccgctggtccatcaggatcaggctatcctcacatgccatagcgcgttttacggagaccatgcgcaaaagaaccagatacagtggtccattgacctggtggactctgtactaaacaaaaaatgtatcaggaaaacatacatagcaaataaagacgtgacaagtaagattaacggttttcaaattatggaggattgattattatgagtaagaatatcggatgttgtatcgtaacagggcacaaacgcccggatgctgctttagtaaaccgtttcagggaactgcccgtggcaaatatcgatgactgtatgaacaggacggcggccgtccaccagaacatacgccccatgaacagcgcaaagcttttaggtccggccttcacggtaaaggttccacagggagataacctgatgttccacaaagccatggatcttgcaatgccaggtgatgtcatcgtgattgatgcagggggaatggacaaccgcgccatcttcggcgaattgatggttcaatactgtaagctccgcggcattgccggagtcattgttgacggaacaatacgtgattatgacactatctcacagatggattttccagtctatgcccgcggaatcaatccaaacggtccatataaaaacggaccaggcgaaatcggaaccaccatctcctttggcggccaaatcgtacggcccggggatatcatagcaggggatgcagacggaatcatcgtcatacggccggaagaagccgaggaactggccaatcaggcggatgccgtgttaaagaaagaggccggtatcatggaaaccatggaaacagcaggcacctacagccggccatgggtcgatgaaaagctgaaggaactggggtgtgagtatatgacagacgaagagaggagagcgtatctatgacacctgcaatcatttcactcatcatactcgccatcatggcgttcttctttgtgacagataaactgcctttggcgcttacttccatgttaggcgcagttgttctcgtcctggcagggatacttccaaaggaaaatttgttctctgctttttcaggaagtactgtcgttctcctggcagcaatgatggtgattggttctgctcttttccacacgggaattgcggaaaaaatgagtaatatcatcgtaaaggtaacaggcacttctgaaaatggaatcatgatagccaccgtactggtggccaccatcctttcttccatctgcagcggcgttgctgttgtggccatgctgctgcccattgttatcggaatcagcatgaaggccggtgtatccgtgtcccgtcagatgattcccctggcctttgcagccagtttcggatgtaatctgactttggtgggtgctgccagcaacatagtcgtaaatggccagctggaatccttaggcgccgccccgctgacgttcctggagcttggcaaggtcggggttcctatctgcatctttggtatcttatattttttaaccataggaaagaaagcccttatccagggcgactcatctgataaggattatctcctggaatttaccggcagtgccgatgcctcctcctcaaaccagtttaattccttcaaagccatcctatgcctgattatcctggcggccgtattgattgccatgtctgtaaacagcagcgcattccccatgcatctggtagcaacagccggcgccctgatcatgatactgaccggatgcatcaaggaacatgaggcgtacaaagccattgactggtccactattttcatcgtgggcggcatgagcgcggtatcaaaggcaatggatgtcagcggagccggacttctaatcagcaacggggcaatccggcttctgggagaacaccccagtaagattgccgtacttcttgtcatcttcctgttgacctgtgtccttaccaatatcatgatgaatacctccactgccctgctggtcactccgcttttcatccccattgcatttgccctggatattaatccggcctctatcgcagttgcaatctgtgtcgctgcctccagcccatttttaaccccggtaggttccggcaccaataccctggtggtgcgtcccggcaatctggggtttatggattttttcaaacccggtctgggcatgaccgtggttgtcacagttgtcagtatgatttttattcctttgttttggcctttataatacgcatactgctttttaataaccagaaagatggggttgccaaaaatgtcgtacagggtactgtctgaccatgccgcccacaatggttccgattagttgaatagccgccgccccgcaagtatagccgccaccctgcaagtttaagcttgcgcgtcctggtccgaaaaaggcgccccggtcaacccggagcgcccttatatgcctaactattcacttaaaaatacttcttgcttccccaaagattactcttcttcaaatccagatactcattatatgctttttccagtatctgcttctcattcgaaaacttcagcagatggtatgcttcatagaacttataatatccggaatccagaaagtactcttcccgctgtggtttgctgtaatagctgtcggccatcatcagataccagtgtacgtccttttccaccacgtcctgtggggtgttgaatgaatattggctcttgccgatatacttgataatggatgcactgacaccggtctcctcctttacctcgcggagcgccgtttccttatactcttcgccagcttctactgttcccttaggcaatacccatccttcatacttattcttataattcttgtaaaggacgagaatcttccctcgaaatataaccacaccgccgcagctcgttgcctcaatcattgcaattcctcctggtgttggtgtgaacctggccgtgctgtcgccatacccgaaagtacggcggcactgaccataactggtcttagtatacaacttttggaagggatatgcaaggtttatctgtgttttggggctgggaggtaactggtaattcatttggcaattcatcatgttcatacttttagtaatttattttaatccgccaaggcagaataaccccaaacaaagcgccagcgcagccctccatccgcaaaaaaggataccctgtacattacacaaggtatcctttctgccaatttcctgtctatcctgcctgtcctatccagatatcattccaggctacgcgggcttttccaaatccctacaggtctttccaaattcccgcaggctttccagaccgacgcaggtctttccaagccttctcaggctattccagacccacgcaggtttttcagattcccgcaggctttcccagccccacgcaggtctttcagattcccgcaggctttcccagccacgcaggtctttccaagccaccacaggcctttccccctgcacaggcttcctcaatactgcctcaaccccctgatactgagttcagcgctctcaagcacatcaatcttactgttatcctgctctacaacggcccatgaaagccccagcgcctttgcgcaggagaggatccgcaggttattcatgttcccggtgccgatggcgcagaatgtaggcgcttcctccccatcatccgaaaccgtgccgccaaggctctcataatccttgacgtggatcatttcaagccgggatttcttcccttccatgtaatccacgggatccacccctgcgaaataggcccagaacgtatccagctccaaccccaccgaatcatccgcagataaaatggagtccaggacatagccgttcccgcctgcatcctccttgaattcaaaatcatggttgtggtacagcaggcgcacgccgtatttcctgccaagggcaatcagatccgggatcatatcctttatcttctgatagccttccccggtacgaagcccgggcgccagccagggaatcgtcaggcaggggattccggcctccttggcataaatgaattccccctctgcatccgcttcccaccgttccagctggacatgggagttgcacgcttcaaggttgcagccggcaagcagttccctcatctcgtctgcagctatcccctgatagctgcagaattccacaccgtcatatcccatggctgcaatttttttaattgtatcaatcagcccttctttggttttacataaagactgggcagagtataactgatatcccattttcatgagccggttccccctaaatcaatcgtggtcgtttgcaacctgaaggctgttctccgtatactgcattatctcaatttcattcccttccggatcctggacatagaagccgtaggaattacactgaccaatggttccctcctcggcaaatggcttggtaaagggttcttccatccactcaggaccgtgccagagcgtaaggcccttgtcctccagttcctttgccgcctggaaaatgtcctctaccagcaggcatacatggtggaattcctggtttttggtgtcgttcctgccgatatagggcacgttaaacagctcgatgaattccttcggggcgattttcatatagctgatccactcatcccccggctttgcttctaacggatatcccttctccaggtagccgtctatgatgtcctgctcaaaattgatggtgaacagcttctcaagccccattacctcctcataaaactttaccattttagggtaatcattgcagcagaatgtacagtggctcaatcgattgatatattttcccattttcttttcctcccgttttataattccttgtcatttacaatctgcaggctgtcaggtgtgaattccattaattcccactctccgccctcagggtcaaacacgaacatacagtggctcttgcagagtcccacggaatcatccggcgtacgtcccaccggaaggccttttccttcctccaggtcctttacagctgcaaaacggtcattcacctcaaagcatacatgatagtgggagcgctcacagcgcttctttgtgccgtcgtaatagtccagacggtcagacgggatttccgggattatctctatgtactgtcccggcgccacacggaaataggaaatccatgtctccccgtgttcattgattaaatcaaatgccttcctgaatcccattgtctccgtaaaaaattcttccagcttttccagattgttctccctgcagcgaagcgccacatgaccaagtcccttgtatttgattgccataatctctctccttttcttttatgcccaccacatttgtgcaggttcttcttctataatgatatcctgtaagaattgaactgccttttccaagccttcctttaccgacataaggctgtcctcatgttcaatggataccaccccgtcatatcccgtcatccggagcgcagatatgatatccttccaggtctggctgtcatgtccgtaaccaacggtcctgaaaagccagctcctgttaatctcgtccccatatggtttcgtgtccaggactcctgtcctggccgtattccccttgtcaatccggcagtccttggcatgcacgtaatggatggcatcgcccagttcccggatggcggataccgcatccatcccctgccagaacagatggctggggtcgaagttggcccctatcacatcatcggtggcctccctcaggcgcagcatggtttccgtattgtaaacgcagaagccgggatgcatttcaatggcaacctttacccctgcgcgctttgcaatggccgccgcttccttccagtaaggtaccagcttttcattccactggtagtccagcactttcatgaaatcctccggccaggggcaggtaacccagttagggtagtgggacccgtccgaatcgcccgggcagccggaaaatgtcacgatggtgtccacccccagctcctgtgccagggccacggtatccacaaatgccttatggtccgctgccgctatcttcttatccggatgaatgggattgccatgacaggataaagcagatatcaccatgtcgttctcttccagaagctgttttaattccttgattttatccgggtttcccagaaatacatccggattacagtgcgcgctgttcgtcaccctgctggttcccagttccaccgccttcacgcccaggccgtgcagataaggaagcacgtcctttaatggctgggatgcaaatggtactgttaatgttccgattttcatactaaaactcctctctcacggagcctccgccgcagaaggctgctccgaatactcctattaccatcttgggcagataacggtgaggacagggcctcatatctgcccgaggccatatcaggcggtccgcccgtgatttacagcgttacccagccgccgttttttgcgctttccatgcaggcgtccaccagcttcatgatctgcaccccgtctgcaaaggttgcataggtctgtccggtctgggagaatgtcccccgttcaattgaagcgtagaactcccggattccatttctcagcgcatcgctccatgcaaccggatgtccgcccggaagggtggcataccttaccgcgtccccggaaagcgctgccggtgatgaccggatgatctgcactccgttttccctagtgccgatggacagtacatccgggctttgctgctgccattccatggaacaccgttccccggaaatttccagacgcaggtcattgagatgaccgccgcttacctgggacaggttcaggttccccagcgtcccatcctcaaaccttaccaggatgaacgccgcgtcctctgacgtgacagggaccagttcatacccatcttcctccacgctggcaaatgtctccacctgcctgtcaggcttcttcctaaagggatggacggtcataagctccgcccgcaccgccatgattttcttacccagggcatactgggccgtatcgaaccaatggcttccgatatcggccacggtcctggagtttccgcccatgtcagacgtaagcctccagttataatccgtatcaagcatcatccagtcctgggtatactgccctgtcacatggaagatacgtccaacggaaccattgttcacccgttccttcatctcctggacaatggcattgttcctgtaattaaagttcacgcctgcggccacatggttcttttcggcaaccgccacaagctcctggccctgttccaccgtgattgccaggggtttctcacagtatatgtggattcccttctccatcacatatttattaatttcgtagtgcaggccgttgggcgtgcagttatgtaccacatccggatggatttcgtctatcatctgtctgtaatccgtgtaaatgcgccctacccctaattccgccgcctttgctttaagcgcttcctcattggagtccaccagggccgccacttcattgcccggtatcctgcggaccgcctccacatgctgctgtccggtgaatccggttgcaattaccgctactttccgtttatccatattgatttcctttccctattacttaggaatttacgcaatgccgtactaattacgccatcttcgccttactcatcctgtctgccagttttgtggacatcacatcgaggataattgcaagaaggatcatcacgccttttgctaccagctgccagtttgaatccactcccagcaggttcaggccgttgttgatgacgcctacaatcatacatccgaagatagtcccaaccacgttggcgcttccgcctgaaagaggggttccgccgatgacaacggctgcaatggcgtccaattccgtgttctgtcctgccgctacctgggcagaggcggaacgtgccgtcagcacagtggctgcaatggcgatatatacccccattacggcgtacacgccccagcgcacccttgcgatattaatgccggaaagccttgccgcctccgggtttcctcccattgccagcgcatagcggccgaacttagtcttattcaggatgaataccatgatgaataccattcccagcatgatatataccggaatggggattcccagccagtagccctgtccgattacaatgaactcctgaggcaggttggaaaccggaaccattttcgtcaccagataggtggcgcctttgaatgcggacatggtcgccagggtcacgatgaacggaggcaggtcaaatgcagtgatgattgtggcactgatcgtgccgcaggcaacgcctgccacgcaggcccccagcacagccaccggaatcggaacgcccgccaccaggaattttccaaggattacgcctaccagacctaccatacagccaaccgccaggtcgatgtggccggagcttaaaagcagcgtatagccggctgataaaataacactgtatgccacctgacggatcaggttccttaagttgcctccgctggtgaagattccgtttgtgccaattgccatcaatataaacaggatgatcagaatgaccagcgccttattatccattacgaatttcccgatgggggtatccagcaaagtgtcttttttctttgtcttatccatttttccaatcctttctccgtatataattaagcctgggatgctccgaatgcatgggttatcaggctttcctgggttgcctccgcccggtcgcattcacagaccacccgtccgtggcggattaccaggatccggtcgctcatccccaggatttccggaagctccgaggaaatcatgatgatggccatgccttttcctgccagcgtgctgagaagcttatggatttccgacttggaacccacatcgatgcccctggtaggctcatccacaatcagtaccttaggctctgtcagcagccatctgccaatcaggaccttctgctggttgccgccggagagctggctgatcagctgtttttcagaggaacatttgaccgccatcatatcccggttttcctcaaacacttcccgttcctttttgctgtcaatcacacccattttattgcaaagcctgcccagcaccgcaatggtggtgttggccttgacggaaagggcatatatggatcccgaccgcatacggtcttccgtcagcatggccaggccgttgtccagggcgtcctttggattccttatacgcacctgtcttccgtctataaagacctcaccggaatcctttgggtcgctgccgaatacggcgcgcatgatttccgaccgcccggctcccaccagaccgctgattcccaggatttcccccctgcggacagagaaattaatatccttaaacacaccgatacggttaaagttcttcacttccaggacaacatcgccaatctctgccgtctgcttcgggaacaggttggtgatatcgcgtcccgcaatcatattgaccagttcaggctgcgtgatgtccgtacagtccctggtagctatgtactgaccgtcccggtatacggatacacggtcgcatatgtcgaatatttcttccagtttatgggatatgaaaataatggatacgcccttcctggataaatccgctacaatccggtaaagcgtcttaacctcgtcatccgccaaagccgaagtgggttcatccatgataatcacatctgcgccataggaggttgcacggatcagctctaccatctgcatctgcgccaccgacagattcttcaccagggccttgatatccagcttgatatccagttgtttcaacagttcttccgtcttttcatacctggcctttttgtggatcatgcccgccttcatgaactggttttcccggcccagccagatattctccgttacatccatggtggggatcaggcttatctcctggtggatcattgcaattccggaatgcagcgcatccaggggactggtaaaattcacctttttccctttataagtcaccgtgccctcctccggggtgtagattcccaggagaaccttcataagagtagactttccggctccattttcgccaatgaccgcatgcacctcccctttccgaagctccaggtccactttatccagtgccctgacgccgggaaacagcttggtgattccttccatttttaaaattatctcttgactcatatatctacctcatctcaagcgccgattatcagtaaagaaagggcgggctgtaaccgccctcttgacatccttaattcatattcatgtattcgtctatgttttcgctggtcagtaccaccaggccgtcctcgcctgccgtggcaaaagaatccgtaaatgtaccgtcaatcgcgcctatgcagatatccaggcgtacgccctcaatcttttcctggtccgccaggacagtcattgtctggttgccaagcttaatctgttcacgtccgatttttgtcccgtcaacgcccattgtaaggaaaccgctcttgccctgtgcgataagcgcattgcacaccccaagggtcatatcatcggatgcagtggaaacagcgttcatctccggatatctcatgagccagtcttccgtgatgttagtggccttgtccgtgctccagtccgcgtactgggaatccaggaccttcacacggtccggcatctcctctgccagctccagcacatcctgattcctcttaagctgctctgtctgggatgcaattccataaatcaggccgaagttaaggaccgtatccgggttctcatccagataattaaggatgaacttctttttcatctccttaatggaatcctcatccatgccgcggaaggaaatatccacgctttcatcttccgtgccgcgctctcccatggttatgatgccggctgcctttgctgcctggaatgccgggattgcgccgctggtgtcaacttcacttataataaggatgtccgggttctgtacaatcagagattccacatcggcaagctgcttatcctggctggcctgcgcgtcggtggtaatgatctcaatggcaacatcgggatgttccgccatataggcgtccgcctcagcctgaaacgcaatcatgctccgtttattattttcatccaggtttgaaaatgattttgctatcttataaacctttttcccatcatccgcagcctgttccccgctggcagtgctgctcttgcctgttgtaccggcaaccgcgtttcctttgtctcctccgcaccctgcaagggataccaccattgctgctgtcaataacattgctgctgctttcttcattactaaatcctcctcataattatataagttttataacagccttgccgccaaccatgtgattgcggtttgtttcattcgtttcatcgctgtttctgaaataatcataatcctttcaggaaaacttgtcaacgcttttgtacttttttgtgattttgcataatttaacatttttttattgtgcaatatgcacattttattcccactgaaaatatttttcactgaaatatattgatttttttcagaaaaccgattatagttgaactagaaacataaataatattgtttttttctgaaaatcatttggaattggagcagtgccatgaatacgaatttagatatgaataagaaagtcaaagtatcagaaatagctgctgtggcaggagtttcgcctgctacggtatcacgggtgattaatcagagggaaatcgtcaagggggagacttatgaaaaagtcatccaggccatgaaacagctgggatgcagcatcaatgaatcccccatcccccagcccgcctccacaggccttatcctcattaatatcccttcccttaacaaccccttttacggcgccatcataaagggggcgcgtgcgtcgatttcacgccatggttattccatgttgattaatgaaggccatattaatccaggcaccattgacttgcttgtgaaaacactcaagcagaacaaggtaatcggcctgattaccatgaactgcattgaaacgtcattgattaagaaattgtcggataccacctgcgtggtacagtgctgtgaatacaatgaggataccgaccttccatatgtcagcataaacgatgtcgcttccgccaagatggcggtggaacatctgctggcccagggaaagaagcggatagccttcatcaacggccccttccggtataaatacgccaagcaccgtctgcagggatatatgcaggcgctggaagaagccggggtcccggtggaccaggaatatatcgtacagctgcctgagatagactccgacctggccacctccgccgccttgcagttacttaacctgagcgaacccccggatgcatttttcaccgtatccgatgtttacggtgcggcggtcctgcgcgcctgttacctctccaagcgcagggtgccggaacaggtggccgtggtgggctttgataatctggaaatatcaaaaagcctggtccccgccctgagcacggtcaaccagcccaagtcgcagctgggattcatggccgctgaaacactttttgagaaaatcgccaatcccgccatacccaacaaaaaaatactgctggataccgaactcattgtgcgcgagtcctcatccctgtaaaacaaacgaaaggattacttatattatggaacacatgctccgcgaaccagcgaaagattcaaatgaaatcacaagggaatattttgatgaaatacttgtagaaatgcgccacatcggtgcggttacccccgataccaccttaaacctctatgggaagacattttccacccccataatgatggccgcgctctcccatctgaaaggcatggacggcaaaggggacgggatggttgaaatggcccagggcgccaggatggcaggaaccgtcaactgggccgggatggggacggaggaacagttttctgccattgccgccaccggcgcccccaccatccggatcatcaagccttacgaggacgaatcccttgtgttaaggaaaatagcgcaggccgaagagctgggcgccctggcggtggggatggaccttgaccatgcatttaacgccaggggcagggctgacaatgtccttggacaccccatgcggcccaggaccttaaaggagattgaaagttactgccgcaggacaaagcttccctttatcctcaaagggatactcagcgcggcggacgcaggaaaatgcctggaggcaggagccggggggattgtagtctcccaccatcacggaatcatccccacagcggttgccccccttatggtccttcctgaaattgcagacgtaatcagaaagaggatccccatctttgttgactgcggcatcatgaatggagccgacgccttcaaggccctggcccttggcgccacagccgtcagcgtgggccgacctgtgatgaaggccatatcaaaaagcggcgc
